US008329188B2

(12) United States Patent
Moyle et al.

(10) Patent No.: US 8,329,188 B2
(45) Date of Patent: Dec. 11, 2012

(54) HUMAN M2E PEPTIDE IMMUNOGENS

(75) Inventors: Matthew Moyle, Redmond, WA (US); Jennifer Mitcham, Redmond, WA (US)

(73) Assignee: Theraclone Sciences, Inc., Seattle, WA (US)

( * ) Notice: Subject to any disclaimer, the term of this patent is extended or adjusted under 35 U.S.C. 154(b) by 136 days.

(21) Appl. No.: 12/617,243

(22) Filed: Nov. 12, 2009

(65) Prior Publication Data
US 2010/0135955 A1 Jun. 3, 2010

Related U.S. Application Data

(60) Provisional application No. 61/113,880, filed on Nov. 12, 2008.

(51) Int. Cl.
*A61K 39/12* (2006.01)
(52) U.S. Cl. .................. 424/186.1; 424/209.1; 530/300
(58) Field of Classification Search .................. None
See application file for complete search history.

(56) References Cited

U.S. PATENT DOCUMENTS

| 4,033,940 | A | 7/1977 | Hughes et al. |
|---|---|---|---|
| 4,102,877 | A | 7/1978 | Nutt |
| 4,816,567 | A | 3/1989 | Cabilly et al. |
| 5,057,540 | A | 10/1991 | Kensil et al. |
| 5,500,362 | A | 3/1996 | Robinson et al. |
| 5,641,870 | A | 6/1997 | Rinderknecht et al. |
| 5,821,337 | A | 10/1998 | Carter et al. |
| 6,090,388 | A | 7/2000 | Wang |
| 6,207,646 | B1 | 3/2001 | Krieg et al. |
| 2006/0115489 | A1* | 6/2006 | Birkett et al. ............. 424/189.1 |

FOREIGN PATENT DOCUMENTS

| EP | 404097 A2 | 12/1990 |
|---|---|---|
| WO | WO-9219265 A1 | 11/1992 |
| WO | WO-9311161 A1 | 6/1993 |
| WO | WO-9313302 A1 | 7/1993 |
| WO | WO-0018434 A1 | 4/2000 |
| WO | WO-02098368 A2 | 12/2002 |
| WO | WO-02098369 A2 | 12/2002 |
| WO | WO 2006/061723 * | 6/2006 |
| WO | WO-2007031550 A2 | 3/2007 |

OTHER PUBLICATIONS

De Filette et al., Universal influenza A vaccine: Optimization of M2-based constructs, 2005, Virology, vol. 337, pp. 149-161.*
Wu et al., Humanization of a Murine Monoclonal ntibody by Simultaneous Optimization of Framework and DDR Residues, 1999, Journal of Molecular Biology, vol. 294, pp. 151-162.*
Feng et al. "Influenza A Virus Infection Engenders a Poor Antibody Response Against the Ectodomain of Matrix Protein 2." *Virol. J.* 3.102(2006).
Altschul et al., "Basic Local Alignment Search Tool", *J. Mol. Biol.*, 215:403-410 (1990).
Altschul et al., "Gapped BLAST and PSI-BLAST: a new generation of protein database search programs", *Nucl. Acids Res.*, 25:3389-3402 (1977).
Camarero et al., "Biosynthesis of a Head-to-Tail Cyclized Protein with Improved Biological Activity", *J. Am. Chem. Soc.*, 121:5597-5598 (1999).
Camarero et al., "Chemical Synthesis of a Circular Protein Domain: Evidence for Folding-Assisted Cyclization", *Angew. Chem. Int. Ed.*, 37(3):347-349 (1998).
Camerero et al., "Chemoselective backbone cyclization of unprotected peptides", *Chem. Commun.*, 15:1369-1370 (1997).
Capel et al., "Heterogeneity of Human IgG Fc Receptors", *Immunomethods*, 4:25-34 (1994).
Chothia et al., "Canonical Structures for the Hypervariable Regions of Immunoglobulins", *J. Mol. Biol.*, 196:901-917 (1987).
Chothia et al., "Conformations of immunoglobulin hypervariable regions", *Nature*, 342:877-883 (1989).
Ciampor et al., "Regulation of pH by the M2 protein of influenza A viruses", *Virus Res.*, 22(3):247-258 (1992).
Clackson et al., "Making antibody fragments using phage display libraries", *Nature*, 352:624-628 (1991).
Clynes et al., "Fc receptors are required in passive and active immunity to melanoma", *Proc. Natl. Acad. Sci. U.S.A.*, 95:652-656 (1998).
Cox et al., "Adjuvants—a classification and review of their modes of action", *Vaccine*, 15(3):248-256 (1997).
Daeron, M., "Fc Receptor Biology", *Ann. Rev. Immunol.*, 15:203-234 (1997).
Dalum et al., "Therapeutic antibodies elicited by immunization against TNF-α", *Nature Biotechnol.*, 17(7):666-669 (1999).
Dayhoff, M.O., "A model of evolutionary change in proteins—Matrices for detecting distant relationships", in *Atlas of Protein Sequence and Structure*, National Biomedical Research Foundation, Washington, DC, 5(Suppl. 3) pp. 345-358 (1978).
de Haas et al., "Fcγ receptors of phagocytes" *J. Lab. Clin. Med.*, 126:330-341 (1995).
Devlin et al., "Random Peptide Libraries: A Source of Specific Protein Binding Molecules", *Science*, 249(4967):404-406 (1990).
Evans et al., "The Cyclization and Polymerization of Bacterially Expressed Proteins Using Modified Self-Splicing Inteins", *J. Biol. Chem.*, 274(26):18359-18363 (1999).
Frace et al., "Modified M2 proteins produce heterotypic immunity against influenza A virus", *Vaccine*, 17(18):2237-2244 (1999).
Furka et al., "General method for rapid synthesis of multicomponent peptide mixtures", *Int. J. Pept. Protein Res.* 37(6):487-493 (1991).
Gazzano-Santoro et al., "A non-radioactive complement-dependent cytotoxicity assay for anti-CD20 monoclonal antibody", *J. Immunol. Meth.*, 202:163-171 (1996).
Geysen et al., "*A Priori* Delineation of a Peptide Which Mimics a Discontinuous Antigenic Determinant", *Mol. Immunol.*, 23(7):709-715 (1986).

(Continued)

*Primary Examiner* — Benjamin P Blumel
(74) *Attorney, Agent, or Firm* — Mintz Levin Cohn Ferris Glovsky and Popeo, P.C.; Ivor R. Elrifi; Katherine J. Miller

(57) ABSTRACT

The present invention provides novel peptide immunogens comprising influenza virus matrix 2 protein epitopes and related compositions and methods. The present invention relates to a composition comprising a peptide immunogen useful for the prevention and treatment of an influenza virus-mediated disease. The invention also relates to vaccines, immunogenic products and immunogenic compositions containing the peptide immunogens.

7 Claims, 8 Drawing Sheets

OTHER PUBLICATIONS

Geysen et al., "The delineation of peptides able to mimic assembled epitopes", in *Synthetic peptides as antigens*, Wiley, Chichester, Ciba Foundation Symposium 119, pp. 130-149 (1986).

Goebel et al., "Studies on Antibacterial Immunity Induced by Artificial Antigens", *J. Exp. Med.*, 69:353-364 (1939).

Goldenburg et al., "Circular and Circularly Permuted Forms of Bovine Pancreatic Trypsin Inhibitor", *J. Mol. Biol.*, 165:407-413 (1983).

Grambas et al., "Maturation of Influenza A Virus Hemagglutinin—Estimates of the pH Encountered during Transport and its Regulation by the M2 Protein", *Virology*, 190:11-18 (1992).

Guyer et al., "Immunoglobin Binding by Mouse Intestinal Epithelial Cell Receptors", *J. Immunol.*, 117(2):587-593 (1976).

Hein, J., "Unified Approach to Alignment and Phylogenes", *Meth. Enzymol.*, 183:626-645 (1990).

Henikoff et al., "Amino acid substitution matrices from protein blocks", *Proc. Nat'l. Acad. Sci. U.S.A.*, 89:10915-10929 (1989).

Higgins et al., "Fast and sensitive multiple sequence alignments on a microcomputer", *CABIOS*, 5:151-153 (1989).

Holliger et al., "'Diabodies': Small bivalent and bispecific antibody fragments", *Proc. Natl. Acad. Sci. U.S.A.*, 90:6444-6448 (1993).

Ito et al., "Evolutionary Analysis of the Influenza A Virus M Gene with Comparison of the M1 and M2 Proteins", *J. Virology*, 65(10):5491-5498 (1991).

Iwai et al., "Circular β-lactamase: stability enhancement by cyclizing the backbone", *FEBS Lett.*, 459(2):166-172 (1999).

Jackson et al., "Enzymatic Cyclization of Linear Peptide Esters Using Subtiligase", *J. Am. Chem. Soc.*, 117:819-820 (1995).

Jones et al., "Replacing the complementarity-determining regions in a human antibody with those from a mouse", *Nature*, 321:522-525 (1986).

Kim et al., "Localization of the site of the murine IgG1 molecule that is involved in binding to the murine intestinal Fc receptor", *Eur. J. Immunol.*, 24:2429-2434 (1994).

Kohler et al., "Continuous cultures of fused cells secreting antibody of predefined specificity", *Nature*, 256:495-497 (1975).

Lam et al., "A new type of synthetic peptide library for identifying ligand-binding activity", *Nature*, 354(6348):82-84 (1991).

Le et al., "Avian Flu: Isolation of Drug-Resistant H5N1 Virus", *Nature*, 437(7062):1108 (2005).

Lipatov et al., "Influenza: Emergence and Control", *Virology*, 78(17):8951-8959 (2004).

Manning et al., "Stability of Protein Pharmaceuticals", *Pharm. Res.*, 6(11):903-918 (1989).

Marks et al., "By-passing Immunization. Human Antibodies from V-gene Libraries Displayed of Phage", *J. Mol. Biol.*, 222:581-597 (1991).

Merrifield et al., "Solid Phase Synthesis (Nobel Lecture)", *Angew Chem.*, 24:799-810 (1985).

Moore, M. L., "Peptide Design Considerations", in *Synthetic Peptides: A User's Guide*, Ed. Grant, WH Freeman and Company, New York, NY, Ch. 2, pp. 63-67 (1992).

Morrison et al., "Chimeric human antibody molecules: Mouse antigen-binding domains with human constant region domains", *Proc. Nat'l. Acad. Sci. U.S.A.*, 81:6851-6855 (1984).

Muller, R., "Determination of Affinity and Specificity of Anti-Hapten Antibodies by Competitive Radioimmunoassay", *Meth. Enzymol.*, 92:589-601 (1983).

Myers et al., "Optimal alignments in linear space", *CABIOS*, 4(1):11-17 (1988).

Needleman et al., "A General Method Applicable to the Search for Similarities in the Amino Acid Sequence of Two Proteins", *J. Mol. Biol.*, 48:443-453 (1970).

Neirynck et al., "A universal influenza A vaccine based on the extracellular domain of the M2 protein", *Nature Med.*, 5(10):1157-1163 (1999).

Osterholm et al., "Preparing for the Next Pandemic", *N. E. J. Med.*, 352:1839-1842(2005).

Pearson et al., "Improved tools for biological sequence comparison" *Proc. Natl. Acad. Sci. U.S.A.*, 85:2444-2448 (1988).

Pluckthun, "Antibodies from *Escherichia coli*" in *The Pharmacology of Monoclonal Antibodies*, Rosenburg and Moore, Eds., 113:269-315 (1994).

Presta, "Antibody engineering", *Curr. Op. Struct. Biol.*, 2:593-596 (1992).

Ravetch et al., "Fc Receptors", *Ann. Rev. Immunol.*, 9:457-492 (1991).

Riechmann et al., "Reshaping human antibodies for therapy", *Nature*, 332:323-329 (1988).

Robinson, D. F., "Comparison of Labeled Trees with Valency Three", *J. Comb. Theor.*, 11:105-119 (1971).

Saitou et al, "The Neighbor-joining Method: A New Method for Reconstructing Phylogenetic Trees", *Mol. Biol. Evol.*, 4:406-425 (1987).

Scatchard, G., "The Attractions of Proteins for Small Molecules and Ions", *Ann. N.Y. Acad. Sci. U.S.A.*, 51:660-672 (1949).

Schneerson et al., "Serum Antibody Responses of Juvenile and Infant Rhesus Monkeys Injected with Haemophilus influenzae Type b and *Pneumococcus* Type 6A Capsular Polysaccharide-Protein Conjugates", *Infect. Immun.*, 45(3):582-591 (1984).

Schutze et al., "Carrier-induced epitopic suppression, a major issue for future synthetic vaccines", *J Immunol.*, 135(4):2319-2322 (1985).

Scott et al., "Production of cyclic peptides and proteins in vivo", *Proc. Natl. Acad. Sci. U.S.A.*, 96(24):13638-13643 (1999).

Scott et al., "Searching for Peptide Ligands with an Epitope Library", *Science*, 249(4967):386-390 (1990).

Slepushkin et al., "Protection of mice against influenza A virus challenge by vaccination with baculovirus-expressed M2 protein", *Vaccine*, 13(15):1399-1402 (1995).

Smith et al., "Comparison of Biosequences", Adv. Applied Math., 2:482-489 (1981).

Sugrue et al., "Specific structural alteration of the influenza haemagglutinin by amantadine", *EMBO J.*, 9(11):3469-3476 (1990).

Tam et al., "A biomimetic strategy in the synthesis and fragmentation of cyclic protein", *Prot. Sci.*, 7(7): 1583-1592 (1998).

Verhoeyen et al., "Reshaping Human Antibodies: Grafting an Antilysozyme Activity", *Science*, 239:1534-1536 (1988).

Wilbur et al., "Rapid similarity searches of nucleic acid and protein data banks", *Proc. Nat'l. Acad. Sci. U.S.A.*, 80:726-730 (1983).

Wood et al., "A genetic system yields self-cleaving inteins for bioseparations", *Nat. Biotechnol.*, 17(9):889-892 (1999).

Wu et al., "Protein *trans*-splicing by a split intein encoded in a split DnaE gene of *Synechocystis* sp. PCC6803", *Proc. Natl. Acad. Sci. U.S.A.*, 95(16):9226-9231 (1998).

Zapata et al., "Engineering linear F(ab')$_2$ fragments for efficient production in *Escheticha coli* and enhanced antiproliferative activity", *Protein Eng.*, 8(10):1057-1062 (1995).

Zhang et al., "Synthesis and Application of Unprotected Cyclic Peptides as Building Blocks for Peptide Dendrimers", *J. Am. Chem. Soc.*, 119(10):2363-2370 (1997).

De Filette et al. "Improved design of intranasal delivery of an M2e-based human influenza A vaccine." Vaccine, vol. 24, No. 44-46, pp. 6597-6601. Nov. 10, 2006.

Eliasson et al. "CTA1-M2e-DD: A novel mucosal adjuvant targeted influence vaccine." Vaccine, vol. 26, No. 9, pp. 1243-1252. Jan. 10, 2008.

Fiers et al. "M2e-based universal influenza A vaccine." Vaccine, vol. 27, No. 45, pp. 6280-6283. Oct. 23, 2009.

Huleatt et al. "Potent immunogenicity and efficacy of a universal influenza vaccine candidate comprising a recombinant fusion protein linking influenza M2e to the TLR5 ligand flagellin." Vaccine, vol. 26, No. 2, pp. 201-214. Jan. 10, 2008.

Liu et al. "N-terminus of M2 protein could induce antibodies with inhibitory activity against influenza virus replication." FEMS Immunology and Medical Microbiology, vol. 35, No. 2, pp. 141-146. Mar. 20, 2003.

Liu et al. "High epitope density in a single protein molecule significantly enhances antigenicity as well as immunogenicity: a novel strategy for modern vaccine development and a preliminary investigation about B cell discrimination of monomeric proteins." European Journal of Immunology, vol. 35, No. 2, pp. 505-514. Feb. 2005.

Mozdzanowska et al. "Roles of adjuvant and route of vaccination in antibody response and protection engendered by a synthetic matrix protein-2-based influenza A virus vaccine in the mouse." Virology Journal, vol. 4, p. 118. 2007.

Wang et al. "Therapeutic potential of a fully human monoclonal antibody against influenza A virus M2 protein." Antiviral Research, vol. 80, No. 2, pp. 168-177. Jun. 2008.

Wang et al. "Monoclonal antibody recognizing SLLTEVET epitope of M2 protein potently inhibited the replication of influenza A viruses in MDCK cells." Biochemical and Biophysical Research Communications, vol. 385, No. 1, pp. 118-122. Jul. 17, 2009.

Wu et al. "Characterization of immunity induced by M2e of influenza virus." Vaccine, vol. 25, No. 52, pp. 8868-8873. Oct. 22, 2007.

Wu et al. "Heterosubtypic protection conferred by combined vaccination with M2e peptide and split influenza vaccine." Vaccine, vol. 27, No. 43, pp. 6095-6101. Oct. 9, 2009.

Zhang et al. "Fine specificity and sequence of antibodies directed against the ectodomain of matrix protein 2 of influenza A virus." Molecular Immunology, vol. 43, No. 14, pp. 2195-2206. Jul. 2006.

* cited by examiner

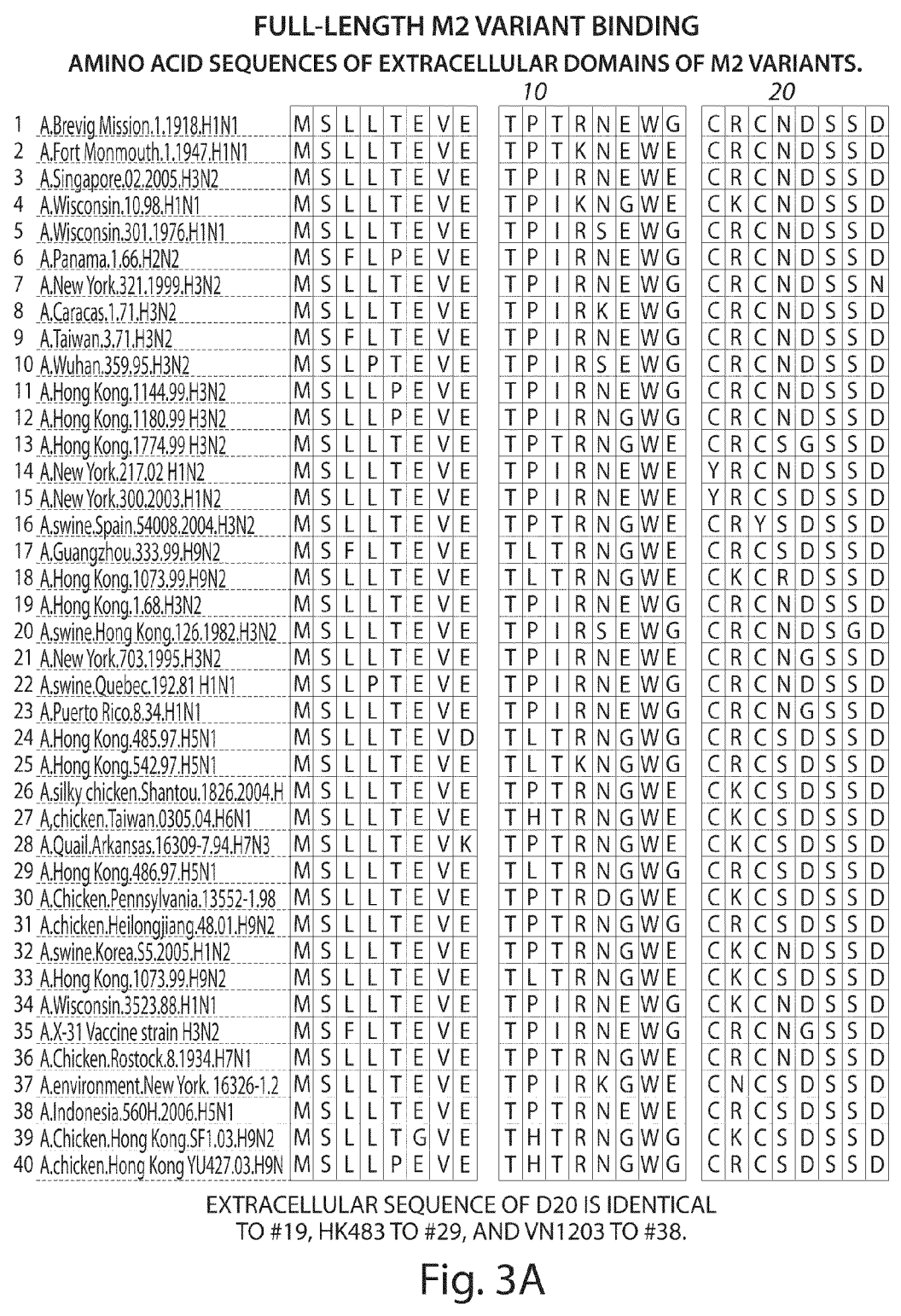

FULL-LENGTH M2 VARIANT BINDING
AMINO ACID SEQUENCES OF EXTRACELLULAR DOMAINS OF M2 VARIANTS.

| # | Strain | 1 | 2 | 3 | 4 | 5 | 6 | 7 | 8 | 9 | 10 | 11 | 12 | 13 | 14 | 15 | 16 | 17 | 18 | 19 | 20 | 21 | 22

CORE SEQUENCES - 1:

| S | L | L | T | E |
|---|---|---|---|---|
| C | A | A | - | D |
| T | C | C |   | C |
|   | F | E |   |   |
|   | K | F |   |   |
|   |   | I |   |   |
|   |   | K |   |   |
|   |   | M |   |   |
|   |   | Q |   |   |
|   |   | S |   |   |
|   |   | T |   |   |
|   |   | V |   |   |

PREFERRED CORE SEQUENCE SHOWN IN BOX; ALLOWABLE VARIANT RESIDUES SHOWN AT EACH POSITION

Fig. 6A

CORE SEQUENCES - 2:

| S | L | L | T | E |
|---|---|---|---|---|
| A | A | B | M | A |
| C | C |   | N | D |
| D | F |   | Q | F |
| L | H |   | S | H |
| T | I |   | W | I |
| V | K |   |   | K |
|   | M |   |   | M |
|   | N |   |   | N |
|   | Q |   |   | Q |
|   | R |   |   | S |
|   | T |   |   | W |
|   | W |   |   | Y |
|   | Y |   |   | C |

PREFERRED CORE SEQUENCE SHOWN IN BOX; ALLOWABLE VARIANT RESIDUES SHOWN AT EACH POSITION; B=ANY RESIDUE

Fig. 6B

CORE VARIANTS:

| S | L | L | T | E |   |   | SEQ ID NO: 47 |
| S | L | L | T | E | X |   | SEQ ID NO: 1597 |
| S | L | L | T | E | X | Z | SEQ ID NO: 1598 |

WHERE X IS ANY AMINO ACID BUT PREFERABLY = V OR C
WHERE Z IS ANY AMINO ACID BUT PREFERABLY = E

Fig. 6C

IMMUNOGENS (LINEAR & CYCLIZED PEPTIDES):

(CORE)
(CORE)G(CORE)
(CORE)G(CORE)G(CORE)
(CORE)G(CORE)G(CORE)G(CORE)
(CORE)G(CORE)G(CORE)G(CORE)G(CORE)

Fig. 6D

IMMUNOGENS (LINEAR & CYCLIZED PEPTIDES):

J(CORE)
J(CORE)G(CORE)
J(CORE)G(CORE)G(CORE)
J(CORE)G(CORE)G(CORE)G(CORE)
J(CORE)G(CORE)G(CORE)G(CORE)G(CORE)

WHERE J IS ANY AMINO ACID BUT PREFERABLY = C

Fig. 6E

SPECIFIC IMMUNOGENS (LINEAR & CYCLIZED PEPTIDES):

| | |
|---|---|
| SLLTEVGSLLTEV | SEQ ID NO: 320 |
| CSLLTEVGSLLTEV | SEQ ID NO: 283 |
| CSLLTECGSLLTCV | SEQ ID NO: 463 |

Fig. 6F

HUMAN M2E PEPTIDE IMMUNOGENS

RELATED APPLICATIONS

This application is related to provisional application U.S. Ser. No. 61/113,880, filed Nov. 12, 2008, the contents of which are herein incorporated by reference in their entirety.

FIELD OF THE INVENTION

The present invention relates generally to vaccines and therapeutics for influenza virus infection. The invention specifically relates to peptide immunogens suitable for generating influenza matrix 2 protein-specific antibodies and their manufacture and use.

BACKGROUND OF THE INVENTION

Influenza virus infects 5-20% of the population and results in 30,000-50,000 deaths each year in the U.S. Although the influenza vaccine is the primary method of infection prevention, four antiviral drugs are also available in the U.S.: amantadine, rimantadine, oseltamivir and zanamivir. As of December 2005, only oseltamivir (TAMIFLU™) is recommended for treatment of influenza A due to the increasing resistance of the virus to amantadine and rimantadine resulting from an amino acid substitution in the M2 protein of the virus. Recently, a drug resistant avian virus was found in a 14-year-girl in Viet Nam. Resistance to Tamiflu has also been found in human influenza as well (Mai Le et al., Nature 437:1108 (2005)).

Influenza vaccines have been demonstrated to have a protective effect against influenza infection. However, yearly emerging antigenic variants of influenza viruses necessitate surveillance to contemporary of circulating virus strains. In some cases, difficulty in the prediction of new variant strains has prevented the timely production of the vaccine (Frace et al., Vaccine 17:2237 (1999)). Recently, pandemic avian influenza has become a serious threat due to the emergence of avian influenza viruses such as $H5N_1$ in southern Asia. The currently available vaccines would be ineffective against avian viruses (Lipatov et al., J. Virology 78:8951 (2004); Osterholm et al., N Engl. Med. 352:1839 (2005)). A third problem with the current vaccine is the ineffectiveness in certain populations with compromised immune systems, for instance premature infants, the elderly, AIDS and transplant patients.

Disease caused by influenza A viral infections is typified by its cyclical nature. Antigenic drift and shift allow for different A strains to emerge every year. Added to that, the threat of highly pathogenic strains entering into the general population has stressed the need for novel therapies for flu infections.

SUMMARY OF THE INVENTION

The present invention relates to a synthetic peptide immunogen capable of inducing antibodies against a M2e target peptide of influenza A virus. In particular, the peptide immunogen of this invention comprises one or more epitopes. Optionally, the peptide immunogen further comprises a general immune stimulator. These peptide immunogens of the present invention are effective, capable of inducing antibodies against influenza A virus to prevent infection by the virus.

The peptide immunogen of this invention is represented by the following formula: $[Xaa_0]_m$-$Xaa_1$-$Xaa_2$-$Xaa_3$-$Xaa_4$-$Xaa_5$-$[Xaa_6]_p$-$[Xaa_7]_q$-$[Xaa_8]$-$[Xaa_0]_m$-$Xaa_1$-$Xaa_2$-$Xaa_3$-$Xaa_4$-$Xaa_5$-$[Xaa_6]_p$-$[Xaa_7]_q]_n$; wherein, m, p and q are independently 0 or 1, n is any number between 0 and 4, $Xaa_0$ is any amino acid, preferably C; $Xaa_6$ is any amino acid, preferably V or C; $Xaa_7$ is any amino acid, preferably E; $Xaa_8$ is any amino acid not including proline, preferably G or A; $Xaa_1$-$Xaa_2$-$Xaa_3$-$Xaa_4$-$Xaa_5$- is S-L-L-T-E or, a peptide having a single substitution to the sequence S-L-L-T-E (SEQ ID NO: 47), the substitution selected from the group consisting of: $Xaa_1$ is C or T; $Xaa_2$ is A, C, F or K, $Xaa_3$ is A, C, E, F, I, K, M, Q, S, T or V, and $Xaa_5$ is D or C.

In another aspect the peptide immunogen of this invention is represented by the following formula: $[Xaa_0]_m$-$Xaa_1$-$Xaa_2$-$Xaa_3$-$Xaa_4$-$Xaa_5$-$[Xaa_6]_p$-$[Xaa_7]_q$-$[Xaa_8]$-$[Xaa_0]_m$-$Xaa_1$-$Xaa_2$-$Xaa_3$-$Xaa_4$-$Xaa_5$-$[Xaa_6]_p$-$[Xaa_7]_q]_n$; wherein, m, p and q are independently 0 or 1, n is any number between 0 and 4, $Xaa_0$ is any amino acid, preferably C; $Xaa_6$ is any amino acid, preferably V or C; $Xaa_7$ is any amino acid, preferably E; $Xaa_8$ is any amino acid not including proline, preferably G or A; $Xaa_1$-$Xaa_2$-$Xaa_3$-$Xaa_4$-$Xaa_5$- is S-L-L-T-E or, a peptide having a single substitution to the sequence S-L-L-T-E (SEQ ID NO: 47), the substitution selected from the group consisting of: $Xaa_1$ is A, C, D, L, T or V, $Xaa_2$ is A, C, F, H, I, K, M, N, Q, R, T, W, or Y, $Xaa_3$ is any amino acid, $Xaa_4$ is M, N, Q, S, or W, and $Xaa_5$ is A, D, F, H, I, K, M, N, Q, S, W, Y, or C.

In some aspects of the inventions, one or more amino acids are D-amino acids.

In some aspects of the inventions, the peptide immunogens are cyclic. Cyclization of peptide immunogens can be performed by cross-linking cysteine residues present in the peptide or by chemical means.

In some aspects of the inventions, the peptide immunogens are conjugated to carrier proteins such as KLH through intermolecular crosslinking.

The invention relates to compositions comprising the peptide immunogen and a pharmaceutically acceptable adjuvant and/or carrier selected from the group consisting of alum, liposyn, saponin, squalene, L121, emulsigen monophosphyryl lipid A (MPL), polysorbate 80, QS21, Montanide ISA51, ISA35, ISA206 and ISA 720.

The invention relates to preventing or treating a disease associated with influenza virus infection by administering compositions comprising the peptide immunogens of the invention.

The invention relates to methods for generating antibodies reactive to influenza matrix 2 (M2) protein by administering compositions comprising the peptide immunogens of the invention. It is an object of the invention to develop an immunogen that will enable the generation of high levels of high affinity antibodies against M2 protein.

One aspect of this invention provides a vaccine comprising an immunologically effective amount of a peptide immunogen composition in accordance with this invention and one or more pharmaceutically acceptable carriers. The vaccine when administered at an appropriate dosage will generate immunotherapeutic antibodies directed against influenza A virus.

The present invention provides a vaccine delivery vehicle that is suitable for human or veterinary use for the prophylaxis and treatment of influenza.

The present invention and other objects, features, and advantages of the present invention will become further apparent in the following Detailed Description of the invention and the accompanying figures and embodiments.

BRIEF DESCRIPTION OF THE DRAWINGS

FIG. 3A is a chart showing amino acid sequences of extracellular domains of M2 variants.

FIGS. 6A and 6B are schematic diagrams that depict a core peptide immunogen and amino acid variants that are effective in binding anti-M2e huMAbs 8I10 and 23K12 under high (6A) and low (6B) stringency conditions.

FIG. 6C is a schematic diagram that depicts variants of the core sequence.

FIGS. 6D, 6E and 6F are schematic diagrams that depict specific linear and cyclized peptide immunogens containing the core sequences of the invention.

DETAILED DESCRIPTION

Figure 1:
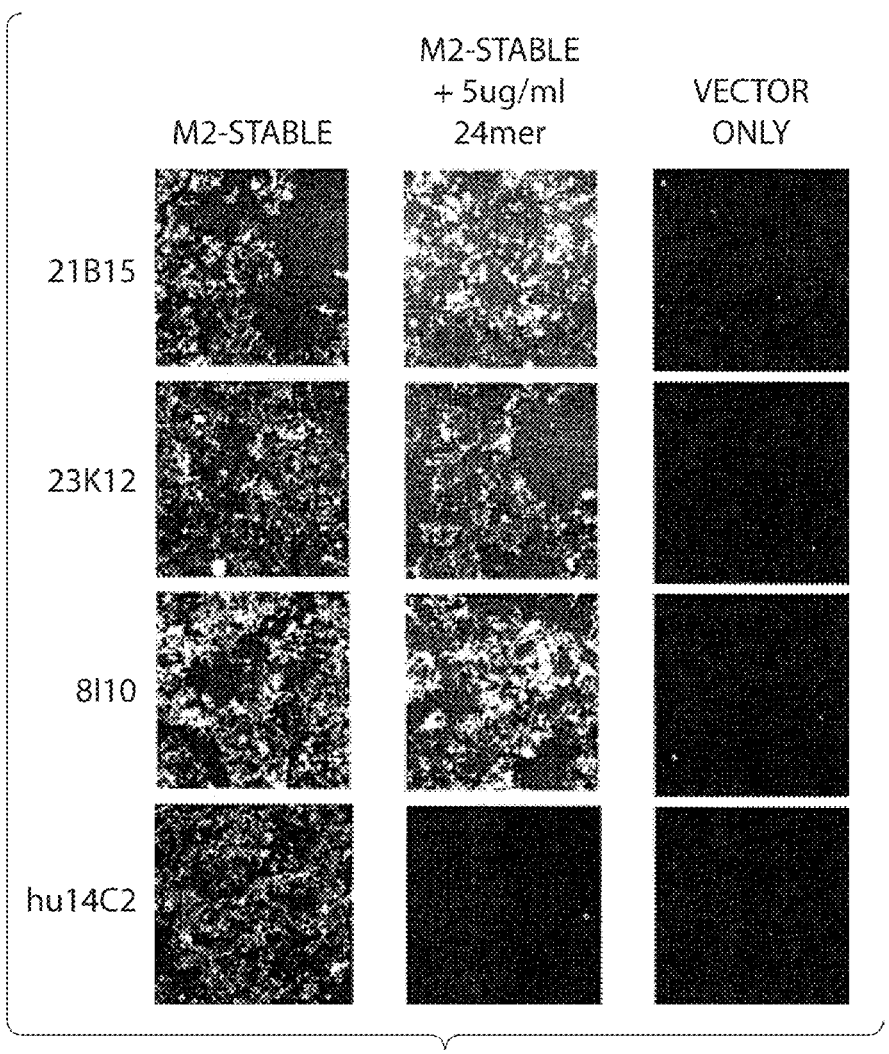
FIG. 1 shows the binding of three anti-M2 antibodies and control hu14C2 antibody to 293-HEK cells transfected with an M2 expression construct or control vector, in the presence or absence of free M2 peptide.

The present invention relates to an immunogenic composition comprising synthetic peptide immunogens capable of inducing antibodies against the extracellular domain of the matrix 2 (M2) polypeptide of influenza A virus. The present invention provides peptides that bind human monoclonal antibodies specific against the extracellular domain of the matrix 2 (M2) polypeptide of influenza A virus.

The predominant fraction of neutralizing antibodies is directed to the polymorphic regions of the hemagglutinin and neuraminidase proteins. A third transmembrane protein of type A influenza virus, matrix protein 2 (M2), is abundantly expressed by virus-infected cells, where it is believed to provide an obligatory transmembrane proton flux for viral replication (Ciampor et al., Virus Research 22:247 (1992); Grambas and Hay, Virology 190:11 (1992); Sugrue et al., EMBO J. 9:3469 (1990)). Unlike HA and NA, M2 is conserved and may represent a target for the development of antibody-based passive immunotherapies for influenza patients (Ito et al., J. Virology 65:5491 (1991); Slepushkin et al., Vaccine 13:1399 (1995); Neirynck et al., Nature Med. 5:1157 (1999)). Thus, such a neutralizing MAb would presumably target only one or a few strains. A recent focus has been on the relatively invariant matrix 2 (M2) protein. Potentially, a neutralizing MAb to M2 would be an adequate therapy for all influenza A strains.

The M2 protein is found in a homotetramer that forms an ion channel and is thought to aid in the uncoating of the virus upon entering the cell. After infection, M2 can be found in abundance at the cell surface. It is subsequently incorporated into the virion coat, where it only comprises about 2% of total coat protein. The M2 extracellular domain (M2e) is short, with the amino terminal 2-24 amino acids displayed outside of the cell.

Anti-M2 monoclonal antibodies to date have been directed towards this linear sequence. Thus, they may not exhibit desired binding properties to cellularly expressed M2, including conformational determinants on native M2.

Recent vaccine development has used immunogenic peptides conjugated to carrier proteins. However, carrier proteins are too complex for use in driving antibody responses to site-specific targets. The mass of the carrier molecule is much greater than that of the functionally important target peptide site. Consequently, the major immune response is directed to the carrier protein rather than to the target site of the peptide immunogen. Moreover, immunization with hapten-carrier conjugates frequently leads to carrier-induced immune suppression (Schutze et al., J Immunol, 1985, 135:2319). A disadvantage with the peptide-carrier protein conjugates is that these molecules are highly complex and are difficult to characterize and it is difficult to develop effective quality control procedures for the manufacturing process.

To be effective, a peptide immunogen must do more than merely evoke an anti-peptide response. An effective peptide immunogen must also evoke a functional immune response, i.e., the antibody produced must have immunological cross-reactivity to the authentic target. It is known that peptide immunogens generally do not retain a preferred structure. Therefore, it is important in designing a peptide target site to introduce structural constraints. However, the imposed structural constraint must be able to mimic the conformation of the targeted epitope so that antibodies evoked will be cross-reactivities to that site on the authentic molecule (Moore, Chapter 2 in Synthetic Peptides A User's guide, ed Grant, WH Freeman and Company: New York, 1992, pp 63-67). Peptide immunogens have been designed employing promiscuous Th epitopes, the invasin domain, and with imposed structural constraint for a peptide-based vaccine for HIV (U.S. Pat. No. 6,090,388).

A long-felt need exists in the art for new antibodies that bind to the cell-expressed M2 and conformational determinants on the native M2. Accordingly, a suitable peptide-based immunogen that mimic M2 is needed for generating vaccines and therapeutics against influenza virus. It would be desirable to provide a synthetic peptide immunogen that generates a site-specific immune response without epitopic suppression by undesirable T cell responses. The peptide-based anti-M2e immunogen should provoke an early and strong immune response in humans for protective immunity without the adverse carrier-induced immune suppression. The peptide immunogen should also be stable and well defined chemically with no need of elaborate downstream processing for ease of manufacture and quality control to avoid the need of an elaborate production plant.

M2 is a 96 amino acid transmembrane protein present as a homotetramer on the surface of influenza virus and virally infected cells. M2 contains a 23 amino acid ectodomain (M2e) that is highly conserved across influenza A strains. Few amino acid changes have occurred since the 1918 pandemic strain thus M2e is an attractive target for influenza therapies. Peptides that incorporate immunogenic epitopes of M2e form a preferred aspect of the present invention.

Mimotopes which have the same characteristics as these epitopes, and immunogens comprising such mimotopes which generate an immune response which cross-react with the IgE epitope in the context of the IgE molecule, also form part of the present invention.

The present invention, therefore, includes isolated peptides encompassing these IgE epitopes themselves, and any mimotope thereof. The meaning of mimotope is defined as an entity which is sufficiently similar to the native M2e epitope so as to be capable of being recognized by antibodies which recognize the native M2e epitope; (Gheysen, H. M., et al., 1986, Synthetic peptides as antigens. Wiley, Chichester, Ciba foundation symposium 119, p 130-149; Gheysen, H. M., 1986, Molecular Immunology, 23, 7, 709-715); or are capable of raising antibodies, when coupled to a suitable carrier, which antibodies cross-react with the native M2e epitope.

Monoclonal Antibodies for Screening M2e Peptide Immunogens

The antibodies used for screening the peptide immunogens are referred to herein as huM2e antibodies. Monoclonal antibodies used are specific to the M2 ectodomain (M2e) and derived from full-length M2 is expressed in cell lines. The huM2e antibodies bind conformational determinants on the M2-transfected cells, as well as native M2, either on influenza infected cells, or on the virus itself. The huM2e antibodies do not bind the linear M2e peptide, but they do bind several natural M2 variants expressed upon cDNA transfection into cell lines. The human monoclonal antibodies exhibit specificity for a very broad range of influenza A virus strains.

The huM2e antibodies have one or more of the following characteristics: the huM2e antibody binds a) to an epitope in the extracellular domain of the matrix 2 (M2) polypeptide of an influenza virus; b) binds to influenza A infected cells; and/or c) binds to influenza A virus (i.e., virons). The huM2e antibodies of the invention eliminate influenza infected cells through immune effector mechanisms such as ADCC and promotes direct viral clearance by binding to influenza virons. The huM2e antibodies of the invention bind to the amino-terminal region of the M2e polypeptide. Preferably, the huM2e antibodies of the invention bind to the amino-terminal region of the M2e polypeptide wherein the N-terminal methionine residue is absent. Exemplary M2e sequences include those sequences listed on Table 1 below.

TABLE 1

Exemplary M2e sequences

| Type | Name | Subtype | M2E Sequence | SEQ ID NO: |
|---|---|---|---|---|
| A | BREVIG MISSION.1.1918 | H1N1 | MSLLTEVETPTRNEWGCRCNDSSD | 48 |
| A | FORT MONMOUTH.1.1947 | H1N1 | MSLLTEVETPTKNEWECRCNDSSD | 49 |
| A | .SINGAPORE.02.2005 | H3N2 | MSLLTEVETPIRNEWECRCNDSSD | 50 |
| A | WISCONSIN.10.98 | H1N1 | MSLLTEVETPIRNGWECKCNDSSD | 51 |
| A | WISCONSIN.301.1976 | H1N1 | MSLLTEVETPIRSEWGCRCNDSSD | 52 |
| A | PANAMA.1.66 | H2N2 | MSFLPEVETPIRNEWGCRCNDSSD | 53 |
| A | NEW YORK.321.1999 | H3N2 | MSLLTEVETPIRNEWGCRCNDSSN | 54 |
| A | CARACAS.1.71 | H3N2 | MSLLTEVETPIRKEWGCRCNDSSD | 55 |
| A | TAIWAN.3.71 | H3N2 | MSFLTEVETPIRNEWGCRCNDSSD | 56 |
| A | WUHAN.359.95 | H3N2 | MSLPTEVETPIRSEWGCRCNDSSD | 57 |
| A | HONG KONG.1144.99 | H3N2 | MSLLPEVETPIRNEWGCRCNDSSD | 58 |
| A | HONG KONG.1180.99 | H3N2 | MSLLPEVETPIRNGWGCRCNDSSD | 59 |
| A | HONG KONG.1774.99 | H3N2 | MSLLTEVETPTRNGWECRCSGSSD | 60 |
| A | NEW YORK.217.02 | H1N2 | MSLLTEVETPIRNEWEYRCNDSSD | 61 |
| A | NEW YORK.300.2003 | H1N2 | MSLLTEVETPIRNEWEYRCSDSSD | 62 |
| A | SWINE.SPAIN.54008.2004 | H3N2 | MSLLTEVETPTRNGWECRYSDSSD | 63 |
| A | GUANGZHOU.333.99 | H9N2 | MSFLTEVETLTRNGWECRCSDSSD | 64 |
| A | HONG KONG.1073.99 | H9N2 | MSLLTEVETLTRNGWECKCRDSSD | 65 |
| A | HONG KONG.1.68 | H3N2 | MSLLTEVETPIRNEWGCRCNDSSD | 66 |
| A | SWINE.HONG KONG.126.1982 | H3N2 | MSLLTEVETPIRSEWGCRCNDSGD | 67 |
| A | NEW YORK.703.1995 | H3N2 | MSLLTEVETPIRNEWECRCNGSSD | 68 |
| A | SWINE.QUEBEC.192.81 | H1N1 | MSLPTEVETPIRNEWGCRCNDSSD | 69 |
| A | PUERTO RICO.8.34 | H1N1 | MSLLTEVETPIRNEWGCRCNGSSD | 70 |
| A | HONG KONG.485.97 | H5N1 | MSLLTEVDTLTRNGWGCRCSDSSD | 71 |
| A | HONG KONG.542.97 | H5N1 | MSLLTEVETLTKNGWGCRCSDSSD | 72 |
| A | SILKY CHICKEN.SHANTOU.1826.2004 | H9N2 | MSLLTEVETPTRNGWECKCSDSSD | 73 |
| A | CHICKEN.TAIWAN.0305.04 | H6N1 | MSLLTEVETHTRNGWECKCSDSSD | 74 |
| A | QUAIL.ARKANSAS.16309-7.94 | H7N3NSA | MSLLTEVKTPTRNGWECKCSDSSD | 75 |
| A | HONG KONG.486.97 | H5N1 | MSLLTEVETLTRNGWGCRCSDSSD | 76 |

TABLE 1-continued

Exemplary M2e sequences

| Type | Name | Subtype | M2E Sequence | SEQ ID NO: |
|---|---|---|---|---|
| A | CHICKEN.PENNSYLVANIA.13552-1.98 | H7N2NSB | MSLLTEVETPTRDGWECKCSDSSD | 77 |
| A | CHICKEN.HEILONGJIANG.48.01 | H9N2 | MSLLTEVETPTRNGWGCRCSDSSD | 78 |
| A | SWINE.KOREA.S5.2005 | H1N2 | MSLLTEVETPTRNGWECKCNDSSD | 79 |
| A | HONG KONG.1073.99 | H9N2 | MSLLTEVETLTRNGWECKCSDSSD | 80 |
| A | WISCONSIN.3523.88 | H1N1 | MSLLTEVETPIRNEWGCKCNDSSD | 81 |
| A | X-31 VACCINE STRAIN | H3N2 | MSFLTEVETPIRNEWGCRCNGSSD | 82 |
| A | CHICKEN.ROSTOCK.8.1934 | H7N1 | MSLLTEVETPTRNGWECRCNDSSD | 83 |
| A | ENVIRONMENT.NEW YORK.16326-1.2005 | H7N2 | MSLLTEVETPIRKGWECNCSDSSD | 84 |
| A | INDONESIA.560H.2006 | H5N1 | MSLLTEVETPTRNEWECRCSDSSD | 85 |
| A | CHICKEN.HONG KONG.SF1.03 | H9N2 | MSLLTGVETHTRNGWGCKCSDSSD | 86 |
| A | CHICKEN.HONGKONG.YU427.03 | H9N2 | MSLLPEVETHTRNGWGCRCSDSSD | 87 |

In one embodiment, the peptide immunogens of the invention comprise a M2e peptide that wholly or partially includes the amino acid residues from position 2 to position 7 of M2e (SLLTEV). The huM2e antibodies bind wholly or partially to the amino acid sequence SLLTE (SEQ ID NO: 47) comprising the peptide immunogens of the invention.

Exemplary huM2e monoclonal antibodies that bind to the peptide immunogens are the 8I10, 21B15 and 23K12 antibodies described herein.

The 8I10 antibody includes a heavy chain variable region (SEQ ID NO: 88) encoded by the nucleic acid sequence shown below in SEQ ID NO: 89, and a light chain variable region (SEQ ID NO: 90) encoded by the nucleic acid sequence shown in SEQ ID NO: 91.

The amino acids encompassing the CDRs as defined by Chothia, C. et al. (1989, Nature, 342: 877-883) are underlined and those defined by Kabat E. A. et al. (1991, Sequences of Proteins of Immunological Interest, 5$^{th}$ edit., NIH Publication no. 91-3242 U.S. Department of Heath and Human Services.) are highlighted in bold in the sequences below.

The heavy chain CDRs of the 8I10 antibody have the following sequences per Kabat definition: NYYWS (SEQ ID NO: 92), FIYYGGNTKYNPSLKS (SEQ ID NO: 93) and ASCSGGYCILD (SEQ ID NO: 94). The light chain CDRs of the 8I10 antibody have the following sequences per Kabat definition: RASQNIYKYLN (SEQ ID NO: 95), AA SGLQS (SEQ ID NO: 96) and QQSYSPPLT (SEQ ID NO: 97).

The heavy chain CDRs of the 8I10 antibody have the following sequences per Chothia definition: GSSISN (SEQ ID NO: 98), FIYYGGNTK (SEQ ID NO: 99) and ASCSG-GYCILD (SEQ ID NO: 94). The light chain CDRs of the 8I10 antibody have the following sequences per Chothia definition: RASQNIYKYLN (SEQ ID NO: 95), AASGLQS (SEQ ID NO: 96) and QQSYSPPLT (SEQ ID NO: 97).

```
>8I10 VH nucleotide sequence:
                                                         (SEQ ID NO: 89)
CAGGTGCAATTGCAGGAGTCGGGCCCAGGACTGGTGAAGCCTTCGGAGACCCTGTCCCTCACCTGCACTGTCT

CTGGTTCGTCCATCAGTAATTACTACTGGAGCTGGATCCGGCAGTCCCCAGGGAAGGGACTGGAGTGGATTGG

GTTTATCTATTACGGTGGAAACACCAAGTACAATCCCTCCCTCAAGAGCCGCGTCACCATATCACAAGACACT

TCCAAGAGTCAGGTCTCCCTGACGATGAGCTCTGTGACCGCTGCGGAATCGGCCGTCTATTTCTGTGCGAGAG

CGTCTTGTAGTGGTGGTTACTGTATCCTTGACTACTGGGGCCAGGGAACCCTGGTCACCGTCTCG

>8I10 VH amino acid sequence:
Kabat Bold, Chothia underlined
                                                         (SEQ ID NO: 88)
  Q V Q L Q E S G P G L V K P S E T L S L T C T V S

G S S I S N Y Y W S W I R Q S P G K G L E W I G F

I Y Y G G N T K Y N P S L K S R V T I S Q D T S K

S Q V S L T M S S V T A A E S A V Y F C A R A S C

S G G Y C I L D Y W G Q G T L V T V S

>8I10 VL nucleotide sequence:
```

-continued

```
                                                              (SEQ ID NO: 91)
GACATCCAGATGACCCAGTCTCCATCCTCCCTGTCTGCATCTGTAGGAGACAGAGTCACCATCACTTGCCGGG

CGAGTCAGAACATTTACAAGTATTTAAATTGGTATCAGCAGAGACCAGGGAAAGCCCCTAAGGGCCTGATCTC

TGCTGCATCCGGGTTGCAAAGTGGGGTCCCATCAAGGTTCAGTGGCAGTGGATCTGGGACAGATTTCACTCTC

ACCATCACCAGTCTGCAACCTGAAGATTTTGCAACTTACTACTGTCAACAGAGTTACAGTCCCCCTCTCACTT

TCGGCGGAGGGACCAGGGTGGAGATCAAAC
```

>8I10 VL amino acid sequence:
Kabat Bold, Chothia underlined
                                                              (SEQ ID NO: 90)
D I Q M T Q S P S S L S A S V G D R V T I T C <u>R A</u>

<u>S Q N I Y K Y L N</u> W Y Q Q R P G K A P K G L I S <u>A</u>

<u>A S G L Q S</u> G V P S R F S G S G S G T D F T L T I

T S L Q P E D F A T Y Y C <u>Q Q S Y S P P L T</u> F G G

G T R V E I K

The 21B15 antibody includes antibody includes a heavy chain variable region (SEQ ID NO: 100) encoded by the nucleic acid sequence shown below in SEQ ID NO: 101, and a light chain variable region (SEQ ID NO: 102) encoded by the nucleic acid sequence shown in SEQ ID NO: 103.

The amino acids encompassing the CDRs as defined by Chothia et al. 1989, are underlined and those defined by Kabat et al., 1991 are highlighted in bold in the sequences below.

The heavy chain CDRs of the 21B15 antibody have the following sequences per Kabat definition: NYYWS (SEQ ID NO: 92), FIYYGGNTKYNPSLKS (SEQ ID NO: 93) and ASCSGGYCILD (SEQ ID NO: 94). The light chain CDRs of the 21B15 antibody have the following sequences per Kabat definition: RASQNIYKYLN (SEQ ID NO: 95), AASGLQS (SEQ ID NO: 96) and QQSYSPPLT (SEQ ID NO: 97).

The heavy chain CDRs of the 21B15 antibody have the following sequences per Chothia definition: GSSISN (SEQ ID NO: 98), FIYYGGNTK (SEQ ID NO: 93) and ASCSGGYCILD (SEQ ID NO: 94). The light chain CDRs of the 21B15 antibody have the following sequences per Chothia definition: RASQNIYKYLN (SEQ ID NO: 95), AASGLQS (SEQ ID NO: 96) and QQSYSPPLT (SEQ ID NO: 97).

>21B15 VH nucleotide sequence:
```
                                                              (SEQ ID NO: 101)
CAGGTGCAATTGCAGGAGTCGGGCCCAGGACTGGTGAAGCCTTCGGAGACCCTGTCCCTCACCTGCACTGTCT

CTGGTTCGTCCATCAGTAATTACTACTGGAGCTGGATCCGGCAGTCCCCAGGGAAGGGACTGGAGTGGATTGG

GTTTATCTATTACGGTGGAAACACCAAGTACAATCCCTCCCTCAAGAGCCGCGTCACCATATCACAAGACACT

TCCAAGAGTCAGGTCTCCCTGACGATGAGCTCTGTGACCGCTGCGGAATCGGCCGTCTATTTCTGTGCGAGAG

CGTCTTGTAGTGGTGGTTACTGTATCCTTGACTACTGGGGCCAGGGAACCCTGGTCACCGTCTCG
```

>21B15 VH amino acid sequence:
Kabat Bold, Chothia underlined
                                                              (SEQ ID NO: 100)
Q V Q L Q E S G P G L V K P S E T L S L T C T V S <u>G S S I S</u> N Y Y W S W I R Q S P G K G L E W I G F

I Y Y G G N T K Y N P S L K S R V T I S Q D T S K

S Q V S L T M S S V T A A E S A V Y F C A R <u>A S C</u>

<u>S G G Y C I L D</u> Y W G Q G T L V T V S

>21B15 VL nucleotide sequence:
```
                                                              (SEQ ID NO: 103)
GACATCCAGGTGACCCAGTCTCCATCCTCCCTGTCTGCATCTGTAGGAGACAGAGTCACCATCACTTGCCGCG

CGAGTCAGAACATTTACAAGTATTTAAATTGGTATCAGCAGAGACCAGGGAAAGCCCCTAAGGGCCTGATCTC

TGCTGCATCCGGGTTGCAAAGTGGGGTCCCATCAAGGTTCAGTGGCAGTGGATCTGGGACAGATTTCACTCTC

ACCATCACCAGTCTGCAACCTGAAGATTTTGCAACTTACTACTGTCAACAGAGTTACAGTCCCCCTCTCACTT

TCGGCGGAGGGACCAGGGTGGATATCAAAC
```

>21B15 VL amino acid sequence:
Kabat Bold, Chothia underlined
                                                              (SEQ ID NO: 102)

-continued

D I Q V T Q S P S S L S A S V G D R V T I T C R A

S Q N I Y K Y L N W Y Q Q R P G K A P K G L I S A

A S G L Q S G V P S R F S G S G S G T D F T L T I

T S L Q P E D F A T Y Y C Q Q S Y S P P L T F G G

G T R V D I K

The 23K12 antibody includes antibody includes a heavy chain variable region (SEQ ID NO: 104) encoded by the nucleic acid sequence shown below in SEQ ID NO: 105, and a light chain variable region (SEQ ID NO: 106) encoded by the nucleic acid sequence shown in SEQ ID NO: 107.

The amino acids encompassing the CDRs as defined by Chothia et al., 1989 are underlined and those defined by Kabat et al., 1991 are highlighted in bold in the sequences below.

The heavy chain CDRs of the 23K12 antibody have the following sequences per Kabat definition: SNYMS (SEQ ID NO: 108), VIYSGGSTYYADSVK (SEQ ID NO: 109) and CLSRMRGYGLDV (SEQ ID NO: 110). The light chain CDRs of the 23K12 antibody have the following sequences per Kabat definition: RTSQSISSYLN (SEQ ID NO: 111), AASSLQSGVPSRF (SEQ ID NO: 112) and QQSYSMPA (SEQ ID NO: 113).

The heavy chain CDRs of the 23K12 antibody have the following sequences per Chothia definition: GFTVSSN (SEQ ID NO: 114), VIYSGGSTY (SEQ ID NO: 115) and CLSRMRGYGLDV (SEQ ID NO: 110). The light chain CDRs of the 23K12 antibody have the following sequences per Chothia definition: RTSQSISSYLN (SEQ ID NO: 111), AASSLQSGVPSRF (SEQ ID NO: 112) and QQSYSMPA (SEQ ID NO: 113).

```
>23K12 VH nucleotide sequence:
                                                        (SEQ ID NO: 105)
GAGGTGCAGCTGGTGGAGTCTGGGGGAGGCTTGGTCCAGCCTGGGGGGTCCCTGAGAATCTCCTGTGCAGCCT

CTGGATTCACCGTCAGTAGCAACTACATGAGTTGGGTCCGCCAGGCTCCAGGGAAGGGGCTGGAGTGGGTCTC

AGTTATTTATAGTGGTGGTAGCACATACTACGCAGACTCCGTGAAGGGCAGATTCTCCTTCTCCAGAGACAAC

TCCAAGAACACAGTGTTTCTTCAAATGAACAGCCTGAGAGCCGAGGACACGGCTGTGTATTACTGTGCGAGAT

GTCTGAGCAGGATGCGGGGTTACGGTTTAGACGTCTGGGGCCAAGGGACCACGGTCACCGTCTCG

>23K12 VH amino acid sequence:
Kabat Bold, Chothia underlined
                                                        (SEQ ID NO: 104)
E V Q L V E S G G G L V Q P G G S L R I S C A A S

G F T V S S N Y M S W V R Q A P G K G L E W V S V

I Y S G G S T Y Y A D S V K G R F S F S R D N S K

N T V F L Q M N S L R A E D T A V Y Y C A R C L S

R M R G Y G L D V W G Q G T T V T V S

>23K12 VL nucleotide sequence:
                                                        (SEQ ID NO: 107)
GACATCCAGATGACCCAGTCTCCATCCTCCCTGTCTGCATCTGTAGGAGACAGAGTCACCATCACTTGCCGGA

CAAGTCAGAGCATTAGCAGCTATTTAAATTGGTATCAGCAGAAACCAGGGAAAGCCCCTAAACTCCTGATCTA

TGCTGCATCCAGTTTGCAAAGTGGGGTCCCATCAAGGTTCAGTGGCAGTGGATCTGGGACAGATTTCACTCTC

ACCATCAGCGGTCTGCAACCTGAAGATTTTGCAACCTACTACTGTCAACAGAGTTACAGTATGCCTGCCTTTG

GCCAGGGGACCAAGCTGGAGATCAAA

>23K12 VL amino acid sequence:
Kabat Bold, Chothia underlined
                                                        (SEQ ID NO: 106)
D I Q M T Q S P S S L S A S V G D R V T I T C R T

S Q S I S S Y L N W Y Q Q K P G K A P K L L I Y A

A S S L Q S G V P S R F S G S G S G T D F T L T I

S G L Q P E D F A T Y Y C Q Q S Y S M P A F G Q G

T K L E I K
```

Unless otherwise defined, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

The nomenclatures utilized in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

Definitions

The following definitions are useful in understanding the present invention:

The term "antibody" (Ab) as used herein includes monoclonal antibodies, polyclonal antibodies, multispecific antibodies (e.g., bispecific antibodies), and antibody fragments, so long as they exhibit the desired biological activity. The term "immunoglobulin" (Ig) is used interchangeably with "antibody" herein.

An "isolated antibody" is one that has been separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In preferred embodiments, the antibody is purified: (1) to greater than 95% by weight of antibody as determined by the Lowry method, and most preferably more than 99% by weight; (2) to a degree sufficient to obtain at least 15 residues of N-terminal or internal amino acid sequence by use of a spinning cup sequenator; or (3) to homogeneity by SDS-PAGE under reducing or non-reducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The basic four-chain antibody unit is a heterotetrameric glycoprotein composed of two identical light (L) chains and two identical heavy (H) chains. An IgM antibody consists of 5 of the basic heterotetramer unit along with an additional polypeptide called J chain, and therefore contain 10 antigen binding sites, while secreted IgA antibodies can polymerize to form polyvalent assemblages comprising 2-5 of the basic 4-chain units along with J chain. In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain ($V_H$) followed by three constant domains ($C_H$) for each of the α and γ chains and four $C_H$ domains for μ and ε isotypes. Each L chain has at the N-terminus, a variable domain ($V_L$) followed by a constant domain ($C_L$) at its other end. The $V_L$ is aligned with the $V_H$ and the $C_L$ is aligned with the first constant domain of the heavy chain ($C_H 1$). Particular amino acid residues are believed to form an interface between the light chain and heavy chain variable domains. The pairing of a $V_H$ and $V_L$ together forms a single antigen-binding site. For the structure and properties of the different classes of antibodies, see, e.g., Basic and Clinical Immunology, 8th edition, Daniel P. Stites, Abba I. Terr and Tristram G. Parslow (eds.), Appleton & Lange, Norwalk, Conn., 1994, page 71, and Chapter 6.

The L chain from any vertebrate species can be assigned to one of two clearly distinct types, called kappa (κ) and lambda (λ), based on the amino acid sequences of their constant domains ($C_L$). Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated alpha (α), delta (δ), epsilon (ε), gamma (γ) and mu (μ), respectively. The γ and α classes are further divided into subclasses on the basis of relatively minor differences in $C_H$ sequence and function, e.g., humans express the following subclasses: IgG1, IgG2, IgG3, IgG4, IgA 1, and IgA2.

The term "variable" refers to the fact that certain segments of the V domains differ extensively in sequence among antibodies. The V domain mediates antigen binding and defines specificity of a particular antibody for its particular antigen. However, the variability is not evenly distributed across the 110-amino acid span of the variable domains. Instead, the V regions consist of relatively invariant stretches called framework regions (FRs) of 15-30 amino acids separated by shorter regions of extreme variability called "hypervariable regions" that are each 9-12 amino acids long. The variable domains of native heavy and light chains each comprise four FRs, largely adopting a β-sheet configuration, connected by three hypervariable regions, which form loops connecting, and in some cases forming part of, the β-sheet structure. The hypervariable regions in each chain are held together in close proximity by the FRs and, with the hypervariable regions from the other chain, contribute to the formation of the antigen-binding site of antibodies (see Kabat et al., Sequences of Proteins of Immunological Interest, 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

The term "hypervariable region" when used herein refers to the amino acid residues of an antibody that are responsible for antigen binding. The hypervariable region generally comprises amino acid residues from a "complementarity determining region" or "CDR" (e.g., around about residues 24-34

(L1), 50-56 (L2) and 89-97 (L3) in the $V_L$, and around about 1-35 (H1), 50-65 (H2) and 95-102 (H3) in the $V_H$; Kabat et al., Sequences of Proteins of Immunological Interest, 5th Ed. Public Health Service, National Institutes of Health, Bethesda, Md. (1991)) and/or those residues from a "hypervariable loop" (e.g., residues 26-32 (L1), 50-52 (L2) and 91-96 (L3) in the $V_L$, and 26-32 (H1), 53-55 (H2) and 96-101 (H3) in the $V_H$; Chothia and Lesk, J. Mol. Biol. 196:901-917 (1987)).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to polyclonal antibody preparations that include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., Nature, 256:495 (1975), or may be made using recombinant DNA methods in bacterial, eukaryotic animal or plant cells (see, e.g., U.S. Pat. No. 4,816, 567). The "monoclonal antibodies" may also be isolated from phage antibody libraries using the techniques described in Clackson et al., Nature, 352:624-628 (1991) and Marks et al., J. Mol. Biol., 222:581-597 (1991), for example.

The monoclonal antibodies herein include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., Proc. Natl. Acad. Sci. USA, 81:6851-6855 (1984)). The present invention provides variable domainantigen-binding sequences derived from human antibodies. Accordingly, chimeric antibodies of primary interest herein include antibodies having one or more human antigen binding sequences (e.g., CDRs) and containing one or more sequences derived from a non-human antibody, e.g., an FR or C region sequence. In addition, chimeric antibodies of primary interest herein include those comprising a human variable domain antigen binding sequence of one antibody class or subclass and another sequence, e.g., FR or C region sequence, derived from another antibody class or subclass. Chimeric antibodies of interest herein also include those containing variable domain antigen-binding sequences related to those described herein or derived from a different species, such as a non-human primate (e.g., Old World Monkey, Ape, etc). Chimeric antibodies also include primatized and humanized antibodies.

Furthermore, chimeric antibodies may comprise residues that are not found in the recipient antibody or in the donor antibody. These modifications are made to further refine antibody performance. For further details, see Jones et al., Nature 321:522-525 (1986); Riechmann et al., Nature 332:323-329 (1988); and Presta, Curr. Op. Struct. Biol. 2:593-596 (1992).

A "humanized antibody" is generally considered to be a human antibody that has one or more amino acid residues introduced into it from a source that is non-human. These non-human amino acid residues are often referred to as "import" residues, which are typically taken from an "import" variable domain. Humanization is traditionally performed following the method of Winter and co-workers (Jones et al., Nature, 321:522-525 (1986); Reichmann et al., Nature, 332:323-327 (1988); Verhoeyen et al., Science, 239: 1534-1536 (1988)), by substituting import hypervariable region sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species.

A "human antibody" is an antibody containing only sequences present in an antibody naturally produced by a human. However, as used herein, human antibodies may comprise residues or modifications not found in a naturally occurring human antibody, including those modifications and variant sequences described herein. These are typically made to further refine or enhance antibody performance.

An "intact" antibody is one that comprises an antigen-binding site as well as a $C_L$ and at least heavy chain constant domains, $C_H1$, $C_H2$ and $C_H3$. The constant domains may be native sequence constant domains (e.g., human native sequence constant domains) or amino acid sequence variant thereof. Preferably, the intact antibody has one or more effector functions.

An "antibody fragment" comprises a portion of an intact antibody, preferably the antigen binding or variable region of the intact antibody. Examples of antibody fragments include Fab, Fab', F(ab')$_2$, and Fv fragments; diabodies; linear antibodies (see U.S. Pat. No. 5,641,870; Zapata et al., Protein Eng. 8(10): 1057-1062 [1995]); single-chain antibody molecules; and multispecific antibodies formed from antibody fragments.

The phrase "functional fragment or analog" of an antibody is a compound having qualitative biological activity in common with a full-length antibody. For example, a functional fragment or analog of an anti-IgE antibody is one that can bind to an IgE immunoglobulin in such a manner so as to prevent or substantially reduce the ability of such molecule from having the ability to bind to the high affinity receptor, Fc$_\epsilon$RI.

Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H1$). Each Fab fragment is monovalent with respect to antigen binding, i.e., it has a single antigen-binding site. Pepsin treatment of an antibody yields a single large F(ab')$_2$ fragment that roughly corresponds to two disulfide linked Fab fragments having divalent antigen-binding activity and is still capable of cross-linking antigen. Fab' fragments differ from Fab fragments by having additional few residues at the carboxy terminus of the $C_H1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments that have hinge cysteines between them. Other chemical couplings of antibody fragments are also known.

The "Fc" fragment comprises the carboxy-terminal portions of both H chains held together by disulfides. The effector functions of antibodies are determined by sequences in the Fc region, which region is also the part recognized by Fc receptors (FcR) found on certain types of cells.

"Fv" is the minimum antibody fragment that contains a complete antigen-recognition and -binding site. This fragment consists of a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$ antibody domains connected into a single polypeptide chain. Preferably, the sFv polypeptide further comprises a polypeptide linker between the $V_H$ and $V_L$, domains that enables the sFv to form the desired structure for antigen binding. For a review of sFv, see Pluckthun in The Pharmacology of Monoclonal Antibodies, vol. 113, Rosenburg and Moore eds., Springer-Verlag, New York, pp. 269-315 (1994); Borrebaeck 1995, infra.

The term "diabodies" refers to small antibody fragments prepared by constructing sFv fragments (see preceding paragraph) with short linkers (about 5-10 residues) between the $V_H$ and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, for example, EP 404,097; WO 93/11161; and Hollinger et al., Proc. Natl. Acad. Sci. USA, 90:6444-6448 (1993).

As used herein, an antibody that "internalizes" is one that is taken up by (i.e., enters) the cell upon binding to an antigen on a mammalian cell (e.g., a cell surface polypeptide or receptor). The internalizing antibody will of course include antibody fragments, human or chimeric antibody, and antibody conjugates. For certain therapeutic applications, internalization in vivo is contemplated. The number of antibody molecules internalized will be sufficient or adequate to kill a cell or inhibit its growth, especially an infected cell. Depending on the potency of the antibody or antibody conjugate, in some instances, the uptake of a single antibody molecule into the cell is sufficient to kill the target cell to which the antibody binds. For example, certain toxins are highly potent in killing such that internalization of one molecule of the toxin conjugated to the antibody is sufficient to kill the infected cell.

As used herein, an antibody is said to be "immunospecific," "specific for" or to "specifically bind" an antigen if it reacts at a detectable level with the antigen, preferably with an affinity constant, $K_a$, of greater than or equal to about $10^4$ M$^{-1}$, or greater than or equal to about $10^5$ M$^{-1}$, greater than or equal to about $10^6$ M$^{-1}$, greater than or equal to about $10^7$ M$^{-1}$, or greater than or equal to $10^8$ Affinity of an antibody for its cognate antigen is also commonly expressed as a dissociation constant $K_D$, and in certain embodiments, HuM2e antibody specifically binds to M2e if it binds with a $K_D$ of less than or equal to $10^{-4}$ M, less than or equal to about $10^{-5}$ M, less than or equal to about $10^{-6}$ M, less than or equal to $10^{-7}$ M, or less than or equal to $10^{-8}$ M. Affinities of antibodies can be readily determined using conventional techniques, for example, those described by Scatchard et al. (*Ann. N.Y. Acad. Sci. USA* 51:660 (1949)).

Binding properties of an antibody to antigens, cells or tissues thereof may generally be determined and assessed using immunodetection methods including, for example, immunofluorescence-based assays, such as immuno-histochemistry (IHC) and/or fluorescence-activated cell sorting (FACS).

An antibody having a "biological characteristic" of a designated antibody is one that possesses one or more of the biological characteristics of that antibody which distinguish it from other antibodies. For example, in certain embodiments, an antibody with a biological characteristic of a designated antibody will bind the same epitope as that bound by the designated antibody and/or have a common effector function as the designated antibody.

The term "antagonist" antibody is used in the broadest sense, and includes an antibody that partially or fully blocks, inhibits, or neutralizes a biological activity of an epitope, polypeptide, or cell that it specifically binds. Methods for identifying antagonist antibodies may comprise contacting a polypeptide or cell specifically bound by a candidate antagonist antibody with the candidate antagonist antibody and measuring a detectable change in one or more biological activities normally associated with the polypeptide or cell.

An "antibody that inhibits the growth of infected cells" or a "growth inhibitory" antibody is one that binds to and results in measurable growth inhibition of infected cells expressing or capable of expressing an M2e epitope bound by an antibody. Preferred growth inhibitory antibodies inhibit growth of infected cells by greater than 20%, preferably from about 20% to about 50%, and even more preferably, by greater than 50% (e.g., from about 50% to about 100%) as compared to the appropriate control, the control typically being infected cells not treated with the antibody being tested. Growth inhibition can be measured at an antibody concentration of about 0.1 to 30 µg/ml or about 0.5 nM to 200 nM in cell culture, where the growth inhibition is determined 1-10 days after exposure of the infected cells to the antibody. Growth inhibition of infected cells in vivo can be determined in various ways known in the art. The antibody is growth inhibitory in vivo if administration of the antibody at about 1 µg/kg to about 100 mg/kg body weight results in reduction the percent of infected cells or total number of infected cells within about 5 days to 3 months from the first administration of the antibody, preferably within about 5 to 30 days.

An antibody that "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). Preferably the cell is an infected cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody that induces apoptosis is one that results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptor); and B cell activation.

"Antibody-dependent cell-mediated cytotoxicity" or "ADCC" refers to a form of cytotoxicity in which secreted Ig bound to Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are required for such killing. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, Annu. Rev. Immunol 9:457-92 (1991). To assess ADCC activity of a molecule of interest, an in vitro ADCC assay, such as that described in U.S. Pat. Nos. 5,500,362 or 5,821,337 may be performed. Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al., PNAS (USA) 95:652-656 (1998).

"Fc receptor" or "FcR" describes a receptor that binds to the Fc region of an antibody. In certain embodiments, the FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FCγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see review M. in Daeron, Annu. Rev. Immunol. 15:203-234 (1997)). FcRs are reviewed in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976) and Kim et al., J. Immunol. 24:249 (1994)).

"Human effector cells" are leukocytes that express one or more FcRs and perform effector functions. Preferably, the cells express at least FcγRIII and perform ADCC effector function. Examples of human leukocytes that mediate ADCC include PBMC, NK cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) that are bound to their cognate antigen. To assess complement activation, a CDC assay, e.g., as described in Gazzano-Santoro et al., J. Immunol. Methods 202:163 (1996), may be performed.

The terms "influenza A" and "Influenzavirus A" refer to a genus of the Orthomyxoviridae family of viruses. Influenzavirus A includes only one species: influenza A virus which cause influenza in birds, humans, pigs, and horses. Strains of all subtypes of influenza A virus have been isolated from wild birds, although disease is uncommon. Some isolates of influenza A virus cause severe disease both in domestic poultry and, rarely, in humans.

A "mammal" for purposes of treating n infection, refers to any mammal, including humans, domestic and farm animals, and zoo, sports, or pet animals, such as dogs, cats, cattle, horses, sheep, pigs, goats, rabbits, etc. Preferably, the mammal is human.

"Treating" or "treatment" or "alleviation" refers to both therapeutic treatment and prophylactic or preventative measures; wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for an infection if, after receiving a therapeutic amount of an antibody according to the methods of the present invention, the patient shows observable and/or measurable reduction in or absence of one or more of the following: reduction in the number of infected cells or absence of the infected cells; reduction in the percent of total cells that are infected; and/or relief to some extent, one or more of the symptoms associated with the specific infection; reduced morbidity and mortality, and improvement in quality of life issues. The above parameters for assessing successful treatment and improvement in the disease are readily measurable by routine procedures familiar to a physician.

The term "therapeutically effective amount" refers to an amount of an antibody or a drug effective to "treat" a disease or disorder in a subject or mammal. See preceding definition of "treating."

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

Administration "in combination with" one or more further therapeutic agents includes simultaneous (concurrent) and consecutive administration in any order.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™ polyethylene glycol (PEG), and PLURONICS™.

"Label" as used herein refers to a detectable compound or composition that is conjugated directly or indirectly to the antibody so as to generate a "labeled" antibody. The label may be detectable by itself (e.g., radioisotope labels or fluorescent labels) or, in the case of an enzymatic label, may catalyze chemical alteration of a substrate compound or composition that is detectable.

The term "epitope tagged" as used herein refers to a chimeric polypeptide comprising a polypeptide fused to a "tag polypeptide." The tag polypeptide has enough residues to provide an epitope against which an antibody can be made, yet is short enough such that it does not interfere with activity of the polypeptide to which it is fused. The tag polypeptide is also preferably fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

A "small molecule" is defined herein to have a molecular weight below about 500 Daltons.

The terms "nucleic acid" and "polynucleotide" are used interchangeably herein to refer to single- or double-stranded RNA, DNA, or mixed polymers. Polynucleotides may include genomic sequences, extra-genomic and plasmid sequences, and smaller engineered gene segments that express, or may be adapted to express polypeptides.

An "isolated nucleic acid" is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man.

The term "polypeptide" is used in its conventional meaning, i.e., as a sequence of amino acids. The polypeptides are not limited to a specific length of the product. Peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising CDRs and being capable of binding an antigen or Influenza A-infected cell.

An "isolated polypeptide" is one that has been identified and separated and/or recovered from a component of its natural environment. In preferred embodiments, the isolated polypeptide will be purified (1) to greater than 95% by weight of polypeptide as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or non-reducing conditions using Coomassie blue or, preferably, silver stain. Isolated polypeptide includes the polypeptide in situ within recombinant cells since at least one component of the polypeptide's natural environment will not be present. Ordinarily, however, isolated polypeptide will be prepared by at least one purification step.

A "native sequence" polynucleotide is one that has the same nucleotide sequence as a polynucleotide derived from nature. A "native sequence" polypeptide is one that has the same amino acid sequence as a polypeptide (e.g., antibody) derived from nature (e.g., from any species). Such native sequence polynucleotides and polypeptides can be isolated from nature or can be produced by recombinant or synthetic means.

A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating one or more biological activities of the polypeptide as described herein and/or using any of a number of techniques well known in the art.

Modifications may be made in the structure of the polynucleotides and polypeptides of the present invention and still obtain a functional molecule that encodes a variant or derivative polypeptide with desirable characteristics. When it is desired to alter the amino acid sequence of a polypeptide to create an equivalent, or even an improved, variant or portion of a polypeptide of the invention, one skilled in the art will typically change one or more of the codons of the encoding DNA sequence.

For example, certain amino acids may be substituted for other amino acids in a protein structure without appreciable loss of its ability to bind other polypeptides (e.g., antigens) or cells. Since it is the binding capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences that encode said peptides without appreciable loss of their biological utility or activity.

In many instances, a polypeptide variant will contain one or more conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged.

In making such changes, the hydropathic index of amino acids may be considered. The importance of the hydropathic amino acid index in conferring interactive biologic function on a protein is generally understood in the art (Kyte and Doolittle, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

Polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) CABIOS 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information.

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) Proc. Natl. Acad. Sci. USA 89:10915) alignments, (B) of 50, expectation (E) of 10, M=5, N=−4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

"Homology" refers to the percentage of residues in the polynucleotide or polypeptide sequence variant that are identical to the non-variant sequence after aligning the sequences and introducing gaps, if necessary, to achieve the maximum percent homology. In particular embodiments, polynucleotide and polypeptide variants have at least 70%, at least 75%, at least 80%, at least 90%, at least 95%, at least 98%, or at least 99% polynucleotide or polypeptide homology with a polynucleotide or polypeptide described herein.

"Vector" includes shuttle and expression vectors. Typically, the plasmid construct will also include an origin of replication (e.g., the ColE1 origin of replication) and a selectable marker (e.g., ampicillin or tetracycline resistance), for replication and selection, respectively, of the plasmids in bacteria. An "expression vector" refers to a vector that contains the necessary control sequences or regulatory elements for expression of the antibodies including antibody fragment of the invention, in bacterial or eukaryotic cells. Suitable vectors are disclosed below.

As used in this specification and the appended claims, the singular forms "a," "an" and "the" include plural references unless the content clearly dictates otherwise.

Preferred methods for determining mAb specificity and affinity by competitive inhibition can be found in Harlow, et al., Antibodies: A Laboratory Manual, Cold Spring Harbor Laboratory Press, Cold Spring Harbor, N.Y., 1988), Colligan et al., eds., Current Protocols in Immunology, Greene Publishing Assoc. and Wiley Interscience, N.Y., (1992, 1993), and Muller, Meth. Enzymol. 92:589-601 (1983), which references are entirely incorporated herein by reference.

The techniques to raise antibodies of the present invention to small peptide sequences that recognize and bind to those sequences in the free or conjugated form or when presented as a native sequence in the context of a large protein are well known in the art. Such antibodies include murine, murine-human and human-human antibodies produced by hybridoma or recombinant techniques known in the art.

Screening Peptide Immunogens for Specific Binding to 8i10, or 23K12.

The present invention relates to peptide immunogens that bind HuM2e antibodies. In one embodiment, the antibody is an antibody designated herein as 8i10, 21B15, or 23K12. These antibodies are known to display preferential or specific binding to influenza A infected cells as compared to uninfected control cells of the same cell type.

In particular embodiments, the HuM2e antibodies bind to epitopes within M2e that are only present in the native conformation, i.e., as expressed in cells. In particular embodiments, these antibodies fail to specifically bind to an isolated M2e polypeptide, e.g., the 23 amino acid residue M2e fragment. It is understood that these antibodies recognize non-linear (i.e. conformational) epitope(s) of the M2 peptide. M2 ectodomain (M2e) includes or consists of the amino acid sequence SLLTEVETPIRNEWGCRCNDSSD (SEQ ID NO: 326) and variants thereof (The Center for Disease Control (CDC) influenza A database at www.flu.lanl.gov/).

The specific conformational epitopes within the M2 protein, and particularly within M2e, were identified as peptide immunogens which can be used as vaccines to prevent the development of influenza infection within a subject.

The peptide immunogen sequences were identified by discontinuous epitope mapping using CLIPS™ (Chemically Linked Immunogenic Peptides on Scaffolds; PepScan) technology, which has been developed to improve the biological function of synthetic peptides. CLIPS uses small, chemical "scaffolds" onto which one or more peptides can be attached. In vaccine development, these are ideal for mapping conformational (or 'discontinuous') epitopes because they closely resemble the native structure of proteins.

Binding activity of anti-M2 antibodies to mutant M2 peptides was analyzed with an ELISA assay using different M2 peptides. Human anti-M2 antibody nos. Z3G1, 8I10 and 23K12 were used in the study. Peptides comprising M2e sequences were screened for the ability to specifically bind HuM2e antibodies 8I10 and 23K12 and distinguished from the ability to bind the anti-M2 human monoclonal antibody Z3G1 (ATCC Deposit No. PTA-5967) which has a broad M2 binding spectrum. 8I10 and 23K12 have been characterized for the ability to bind M2 and M2e under conditions resembling native conformation. The assays were performed at both 0.01 μg/mL and 0.001 μg/mL concentrations of peptides. At 0.01 μg/mL, signal levels of 1000 or greater were selected and at 0.001 μg/mL, signal levels of 300 or greater were selected as significant. Most peptides that bind strongly to 8I10 and 23K12 also bind Z3G1.

TABLE 2

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 116 | CLTEVETPIRNEWGSRCSLLTEVETPIRNEWGC | 1922 |
| 117 | CLLTEVETPIRNEWGSCSLLTEVETPIRC | 1865 |

TABLE 2-continued Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 118 | CSLLTEVETPIRNECSLLTEVETC | 1829 |
| 119 | CLTEVETPIRNEWGSRCSLLTEVETPIRNC | 1825 |
| 120 | CSLLTEVETPIRNCSLLTEVETPIRC | 1781 |
| 121 | CSLLTEVETPIRCSLLTEVETPIRC | 1767 |
| 122 | CSLLTEVETPIRNEWCSLLTEVETC | 1752 |
| 123 | CSLLTEVETPIRNECLTEVETPIRNEWGSRC | 1702 |
| 124 | CSLLTEVETPCSLLTEVETPIRC | 1693 |
| 125 | CTEVETPIRNEWGSRSCSLLTEVETPIRNEWGC | 1659 |
| 126 | CETPIRNEWGSRSNDSCSLLTEVETPIRNC | 1650 |
| 127 | CSLLTEVETCSLLTEVETC | 1647 |
| 128 | CSLLTEVETCSLLTEVETPIC | 1638 |
| 129 | CSLLTEVETPIRNCSLLTEVETPIRNC | 1602 |
| 130 | CSLLTEVETPIRNECSLLTEVETPIRC | 1588 |
| 131 | CSLLTEVETPIRCSLLTEVETPIRNC | 1549 |
| 132 | CVETPIRNEWGSRSNDCSLLTEVETPIC | 1548 |
| 133 | CSLLTEVETPIRNECSLLTEVETPIRNC | 1534 |
| 134 | CSLLTEVETCSLLTEVETPIRNC | 1480 |
| 135 | CSLLTEVETPIRNCSLLTEVETPIRNEWC | 1476 |
| 136 | CLTEVETPIRNEWGSRCSLLTEVETC | 1470 |
| 137 | CSLLTEVETPCSLLTEVETPIC | 1458 |
| 138 | CSLLTEVETPIRNEWGCLLTEVETPIRNEWGSC | 1456 |
| 139 | CSLLTEVETPIRNCSLLTEVETPIC | 1449 |
| 140 | CSLLTEVETPIRNEWGCSLLTEVETPIRNEWGC | 1434 |
| 141 | CSLLTEVETPIRNEWCSLLTEVETPIRNEWGC | 1427 |
| 142 | CSLLTEVETCSLLTEVETPC | 1424 |
| 143 | CSLLTEVETPIRNEWGCSLLTEVETPIRNC | 1418 |
| 144 | CSLLTEVETPIRNCSLLTEVETPC | 1405 |
| 145 | CSLLTEVETPIRNECSLLTEVETPIC | 1395 |
| 146 | CSLLTEVETPIRNECSLLTEVETPIRNEWC | 1394 |
| 147 | CSLLTEVETPIRCSLLTEVETC | 1388 |
| 148 | CSLLTEVETPIRNCSLLTEVETPIRNEWGC | 1356 |
| 149 | CTEVETPIRNEWGSRSCLTEVETPIRNEWGSRC | 1348 |
| 150 | CSLLTEVETCSLLTEVETPIRNEWC | 1345 |
| 151 | CSLLTEVETPIRCSLLTEVETPIC | 1340 |
| 152 | CSLLTEVETPIRNECSLLTEVETPIRNEWGC | 1331 |
| 153 | CSLLTEVETPCSLLTEVETPIRNC | 1320 |
| 154 | CETPIRNEWGSRSNDSCSLLTEVETPIRNEC | 1313 |
| 155 | CSLLTEVETPIRNEWCSLLTEVETPIRC | 1293 |
| 156 | CSLLTEVETPCSLLTEVETPC | 1286 |
| 157 | CSLLTEVETPIRNEWGCSLLTEVETPIRC | 1278 |
| 158 | CSLLTEVETPCSLLTEVETPIRNEWC | 1269 |
| 159 | CSLLTEVETPIRNEWGCVETPIRNEWGSRSNDC | 1241 |
| 160 | CSLLTEVETPIRCLLTEVETPIRNEWGSC | 1211 |
| 161 | CPIRNEWGSRSNDSSDCSLLTEVETC | 1206 |
| 162 | CLTEVETPIRNEWGSRCSLLTEVETPIRC | 1203 |
| 163 | CSLLTEVETCSLLTEVETPIRC | 1200 |
| 164 | CSLLTEVETPIRNECSLLTEVETPC | 1194 |
| 165 | CSLLTEVETPIRCSLLTEVETPIRNEC | 1194 |
| 166 | CSLLTEVETPIRNCSLLTEVETC | 1192 |
| 167 | CSLLTEVETPIRCSLLTEVETPIRNEWGC | 1188 |
| 168 | CVETPIRNEWGSRSNDCSLLTEVETPIRC | 1186 |
| 169 | CTPIRNEWGSRSNDSSCSLLTEVETPIRC | 1180 |
| 170 | CSLLTEVETPIRCLTEVETPIRNEWGSRC | 1175 |
| 171 | CSLLTEVETCSLLTEVETPIRNEC | 1172 |
| 172 | CEVETPIRNEWGSRSNCSLLTEVETPIRC | 1168 |
| 173 | CSLLTEVETPIRCSLLTEVETPIRNEWC | 1167 |
| 174 | CSLLTEVETPIRNEWCSLLTEVETPIRNEWC | 1165 |
| 175 | CSLLTEVETPIRNEWGCLTEVETPIRNEWGSRC | 1148 |
| 176 | CPIRNEWGSRSNDSSDCSLLTEVETPIRC | 1146 |
| 177 | CSLLTEVETPIRNEWCSLLTEVETPIC | 1144 |
| 178 | CLLTEVETPIRNEWGSCSLLTEVETPIRNC | 1141 |
| 179 | CSLLTEVETCLLTEVETPIRNEWGSC | 1141 |
| 180 | CSLLTEVETPIRNEWCSLLTEVETPIRNC | 1138 |
| 181 | CSLLTEVETPIRCSLLTEVETPC | 1115 |
| 182 | CSLLTEVETPCLLTEVETPIRNEWGSC | 1111 |
| 183 | CSLLTEVETPIRNCSLLTEVETPIRNEC | 1110 |
| 184 | CTEVETPIRNEWGSRCSLLTEVETPIRC | 1104 |
| 185 | CTPIRNEWGSRSNDSSCSLLTEVETPIRNC | 1103 |
| 186 | CSLLTEVETPCSLLTEVETPIRNEWGC | 1103 |
| 187 | CSLLTEVETPICSLLTEVETC | 1089 |
| 188 | CLTEVETPIRNEWGSRCSLLTEVETPIRNEWC | 1079 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 189 | CSLLTEVETPIRNEWCSLLTEVETPC | 1074 |
| 190 | CETPIRNEWGSRSNDSCSLLTEVETPIRC | 1069 |
| 191 | CLTEVETPIRNEWGSRCSLLTEVETPIC | 1040 |
| 192 | CSLLTEVETPIRNCLLTEVETPIRNEWGSC | 1036 |
| 193 | CSLLTEVETPCSLLTEVETPIRNEC | 1032 |
| 194 | CVETPIRNEWGSRSNDCSLLTEVETPIRNC | 1028 |
| 195 | CSLLTEVETPIRNCLTEVETPIRNEWGSRC | 1027 |
| 196 | CEVETPIRNEWGSRSNCSLLTEVETPIRNC | 1026 |
| 197 | CSLLTEVETPIRNEWGCSLLTEVETPIC | 1023 |
| 198 | CSLLTEVETPCSLLTEVETC | 1018 |
| 199 | CSLLTEVETPIRCTEVETPIRNEWGSRSC | 1017 |
| 200 | CSLLTEVETPIRNEWGCSLLTEVETC | 1014 |
| 201 | CEVETPIRNEWGSRSNCSLLTEVETC | 1007 |
| 202 | CPIRNEWGSRSNDSSDCSLLTEVETPIRNC | 1004 |
| 203 | CSLLTEVETPICSLLTEVETPIRC | 1001 |
| 204 | CTEVETPIRNEWGSRSCSLLTEVETPIRNC | 1000 |
| 205 | CLLTEVETPIRNEWGSCSLLTEVETPIRNEWGC | 1000 |
| 206 | CSLLTEVETPIRNEWGCSLLTEVETPIRNEC | 994 |
| 207 | CSLLTEVETPICSLLTEVETPC | 986 |
| 208 | CSLLTEVETPICSLLTEVETPIRNC | 981 |
| 209 | CSLLTEVETPIRCEVETPIRNEWGSRSNC | 980 |
| 210 | CSLLTEVETPIRNCTEVETPIRNEWGSRSC | 977 |
| 211 | CSLLTEVETPICSLLTEVETPIRNEWC | 975 |
| 212 | CSLLTEVETPIRNEWGCSLLTEVETPIRNEWC | 972 |
| 213 | CETPIRNEWGSRSNDSCSLLTEVETC | 971 |
| 214 | CSLLTEVETPIRNEWCLLTEVETPIRNEWGSC | 961 |
| 215 | CSLLTEVETCLTEVETPIRNEWGSRC | 958 |
| 216 | CTEVETPIRNEWGSRSCSLLTEVETPIC | 957 |
| 217 | CSLLTEVETPIRNEWGCSLLTEVETPC | 955 |
| 218 | CLLTEVETPIRNEWGSCSLLTEVETPIRNEWC | 922 |
| 219 | CEVETPIRNEWGSRSNCSLLTEVETPIC | 912 |
| 220 | CSLLTEVETPIRNECSLLTEVETPIRNEC | 910 |
| 221 | CSLLTEVETPCLTEVETPIRNEWGSRC | 907 |
| 222 | CSLLTEVETPCTEVETPIRNEWGSRSC | 907 |
| 223 | CVETPIRNEWGSRSNDCSLLTEVETC | 905 |
| 224 | CSLLTEVETPICLLTEVETPIRNEWGSC | 901 |
| 225 | CTEVETPIRNEWGSRSCSLLTEVETPIRNEWC | 900 |
| 226 | CTEVETPIRNEWGSRSCSLLTEVETC | 891 |
| 227 | CSLLTEVETPIRNECLLTEVETPIRNEWGSC | 870 |
| 228 | CLTEVETPIRNEWGSRCSLLTEVETPC | 867 |
| 229 | CEVETPIRNEWGSRSNCSLLTEVETPC | 862 |
| 230 | CTPIRNEWGSRSNDSSCSLLTEVETC | 861 |
| 231 | CTPIRNEWGSRSNDSSCSLLTEVETPIC | 854 |
| 232 | CETPIRNEWGSRSNDSCSLLTEVETPC | 842 |
| 233 | CEVETPIRNEWGSRSNCSLLTEVETPIRNEWGC | 838 |
| 234 | CVETPIRNEWGSRSNDCSLLTEVETPIRNEWC | 837 |
| 235 | CSLLTEVETPICLTEVETPIRNEWGSRC | 835 |
| 236 | CSLLTEVETPICSLLTEVETPIRNEWGC | 826 |
| 237 | CETPIRNEWGSRSNDSCSLLTEVETPIC | 825 |
| 238 | CEVETPIRNEWGSRSNCSLLTEVETPIRNEWC | 825 |
| 239 | CSLLTEVETCEVETPIRNEWGSRSNC | 821 |
| 240 | CLTEVETPIRNEWGSRCSLLTEVETPIRNEC | 817 |
| 241 | CSLLTEVETPIRNEWCSLLTEVETPIRNEC | 815 |
| 242 | CVETPIRNEWGSRSNDCSLLTEVETPC | 814 |
| 243 | CTPIRNEWGSRSNDSSCSLLTEVETPIRNEWGC | 812 |
| 244 | CLLTEVETPIRNEWGSCSLLTEVETPIRNEC | 808 |
| 245 | CSLLTEVETPICSLLTEVETPIC | 797 |
| 246 | CTEVETPIRNEWGSRSCSLLTEVETPC | 796 |
| 247 | CTPIRNEWGSRSNDSSCSLLTEVETPC | 794 |
| 248 | CPIRNEWGSRSNDSSDCSLLTEVETPIRNEC | 787 |
| 249 | CPIRNEWGSRSNDSSDCSLLTEVETPIRNEWC | 786 |
| 250 | CSLLTEVETCTEVETPIRNEWGSRSC | 786 |
| 251 | CETPIRNEWGSRSNDSCSLLTEVETPIRNEWC | 784 |
| 252 | CLLTEVETPIRNEWGSCSLLTEVETPIC | 762 |
| 253 | CSLLTEVETPIRNCEVETPIRNEWGSRSNC | 761 |
| 254 | CLLTEVETPIRNEWGSCSLLTEVETC | 752 |
| 255 | CETPIRNEWGSRSNDSCSLLTEVETPIRNEWGC | 749 |
| 256 | CPIRNEWGSRSNDSSDCSLLTEVETPIRNEWGC | 742 |
| 257 | CVETPIRNEWGSRSNDCSLLTEVETPIRNEWGC | 737 |
| 258 | CSLLTEVETPIRNECTEVETPIRNEWGSRSC | 736 |
| 259 | CPIRNEWGSRSNDSSDCSLLTEVETPC | 733 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 260 | CSLLTEVETPICEVETPIRNEWGSRSNC | 731 |
| 261 | CTEVETPIRNEWGSRSCSLLTEVETPIRNEC | 721 |
| 262 | CSLLTEVETPIRNCVETPIRNEWGSRSNDC | 721 |
| 263 | CSLLTEVETPIRNEWGCTEVETPIRNEWGSRSC | 715 |
| 264 | CSLLTEVETCVETPIRNEWGSRSNDC | 707 |
| 265 | CSLLTEVETPCVETPIRNEWGSRSNDC | 704 |
| 266 | CTPIRNEWGSRSNDSSCSLLTEVETPIRNEC | 699 |
| 267 | CPIRNEWGSRSNDSSDCSLLTEVETPIC | 691 |
| 268 | SLLTEVETPIRNECGCRCNDSSD | 682 |
| 269 | CVETPIRNEWGSRSNDCSLLTEVETPIRNEC | 679 |
| 270 | CLLTEVETPIRNEWGSCSLLTEVETPC | 678 |
| 271 | CSLLTEVETPIRCVETPIRNEWGSRSNDC | 678 |
| 272 | CTPIRNEWGSRSNDSSCSLLTEVETPIRNEWC | 677 |
| 273 | CEVETPIRNEWGSRSNCSLLTEVETPIRNEC | 669 |
| 274 | CSLLTEVETPCEVETPIRNEWGSRSNC | 650 |
| 275 | CSLLTEVETPIRNEWGCEVETPIRNEWGSRSNC | 607 |
| 276 | CSLLTEVETPIRNECEVETPIRNEWGSRSNC | 591 |
| 277 | CSLLTEVETPIRNEWCTEVETPIRNEWGSRSC | 575 |
| 278 | CSLLTEVETPIRNEWCLTEVETPIRNEWGSRC | 561 |
| 279 | CSLLTEVETPIRNECVETPIRNEWGSRSNDC | 538 |
| 280 | CSLLTEVETPICTEVETPIRNEWGSRSC | 526 |
| 281 | CSLLTEVETCSLLTEVETPIRNEWGC | 328 |
| 282 | CSCLCEVGMSCLCEC | 2705 |
| 283 | CSLLTEVGSLLTEV | 2494 |
| 284 | ASLLTEVGSLLTCV | 2443 |
| 285 | MSLLTEVGMSLLTCV | 2389 |
| 286 | CSLLTEVGMSLLTCV | 2311 |
| 287 | MSLLTEVGMSLLTEV | 2267 |
| 288 | CSCLCEVGMSLLTEV | 2154 |
| 289 | MSLCTEVGMSLCTEV | 2153 |
| 290 | CSLLTEVGSLLTCV | 2142 |
| 291 | MSLLTEVGMCLCTCV | 2110 |
| 292 | CSLLTEVGSLLTEC | 2094 |
| 293 | CSLLTEVGMSLLTEV | 2039 |
| 294 | MSCLCEVGMSLLTEV | 2039 |
| 295 | MSLCTEVGMSCLTEV | 2026 |
| 296 | MSLLTEVGMCLLTEV | 2023 |
| 297 | CSLLTEVGMCLCTCV | 1972 |
| 298 | SLCTEVGSCLCEC | 1967 |
| 299 | SLLTEVGCLCTCV | 1963 |
| 300 | SLLTEVETKIRNEWGCRCNDSSD | 1960 |
| 301 | SLLCEVGCSLLTEC | 1959 |
| 302 | ASLLTEVGSCLTEV | 1944 |
| 303 | CSLLTEVGMCLLTEV | 1941 |
| 304 | MSLCTEVGMSLLCEV | 1935 |
| 305 | CSCLCEVGMSLLTEC | 1925 |
| 306 | CSLLTECGMSLLTCV | 1918 |
| 307 | SLCTEVGCLCTCV | 1907 |
| 308 | MSLCTEVGMCLCTCV | 1902 |
| 309 | CSLLTEVGMSLLCEV | 1891 |
| 310 | MSCLCECGMSLLTEC | 1887 |
| 311 | SLLTEVGCLLTEV | 1859 |
| 312 | TLLTEVETPIRNEWGCRCNDSSD | 1855 |
| 313 | SLLTEVETPIRNEWGCRCNDSGD | 1852 |
| 314 | SLLTEVGSLLCEV | 1834 |
| 315 | MCLCTCVGCSLLTEC | 1823 |
| 316 | MSLLTEVGCSLLTEV | 1809 |
| 317 | MSLLTEVGMSLCTEV | 1804 |
| 318 | SLLTEVETPIRNEWGCRCKDSSD | 1802 |
| 319 | SLLTECGSLLTCV | 1800 |
| 320 | SLLTEVGSLLTEV | 1794 |
| 321 | ALLTEVETPIRNEWGCRCNDSSD | 1794 |
| 322 | SKLTEVETPIRNEWGCRCNDSSD | 1784 |
| 323 | SLCTEVGSLLTCV | 1781 |
| 324 | SLCTEVGSLLTEV | 1772 |
| 325 | SLLTECGSLLTEV | 1770 |
| 326 | SLLTEVETPIRNEWGCRCNDSSD | 1749 |
| 327 | SLMTEVETPIRNEWGCRCNDSSD | 1729 |
| 328 | SLETEVETPIRNEWGCRCNDSSD | 1720 |
| 329 | SLLTEVGSCLCEC | 1708 |
| 330 | SLLTEVETPIRNEWGCRCNDYSD | 1694 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 331 | MSLLTECGMSLLTCV | 1690 |
| 332 | SALTEVETPIRNEWGCRCNDSSD | 1689 |
| 333 | SLLTCVGSLLTEC | 1683 |
| 334 | CSLLTEVGMSLCTEV | 1682 |
| 335 | CSCLCEVGCSLLTEC | 1677 |
| 336 | SLLCEVGSLLTEV | 1674 |
| 337 | SLLTEVETPIRNEWGCRCNYSSD | 1666 |
| 338 | SLLTEVETPIRNEWGCRCNDGSD | 1666 |
| 339 | MSLLTECGMSLLTEV | 1658 |
| 340 | MSCLCECGCSLLTEC | 1652 |
| 341 | CSLLTEVCSLLTEC | 1644 |
| 342 | SLLTEVETPIRNEWGCRCNSSSD | 1637 |
| 343 | MSLLTEVGMSLLTEC | 1630 |
| 344 | SMLTEVETPIRNEWGCRCNDSSD | 1622 |
| 345 | CSLLTEVGSCLTEV | 1616 |
| 346 | SLLMEVETPIRNEWGCRCNDSSD | 1616 |
| 347 | SLLTEVETPIRNEWICRCNDSSD | 1599 |
| 348 | SLLTECGCSLLTEV | 1597 |
| 349 | SLATEVETPIRNEWGCRCNDSSD | 1583 |
| 350 | SLLTEVETPIRNEWGCRCNDSND | 1577 |
| 351 | SLLCEVGSLLTEC | 1564 |
| 352 | SLQTEVETPIRNEWGCRCNDSSD | 1561 |
| 353 | SLLTEVGCSLLTEC | 1556 |
| 354 | SLLTEVGCSLLTEV | 1555 |
| 355 | SCLCECGCSLLTEV | 1555 |
| 356 | SLLTEVETPIRNEWGCRCNDSDD | 1553 |
| 357 | SLLTEVETPIPNEWGCRCNDSSD | 1548 |
| 358 | SFLTEVETPIRNEWGCRCNDSSD | 1546 |
| 359 | MSLLTEVGMSCLTEV | 1535 |
| 360 | CSLLTECGCSLLTEV | 1534 |
| 361 | SCLCECGCSLLTEC | 1520 |
| 362 | CSLLTECGMCLLTEV | 1517 |
| 363 | MSLLTECGCSLLTEV | 1500 |
| 364 | CSLLTEVGCSLLTEV | 1499 |
| 365 | CSLLTEVCMSLLTEC | 1498 |
| 366 | SLLTEVETPIRNEWWCRCNDSSD | 1498 |
| 367 | SLCTEVGSLLTEC | 1495 |
| 368 | SLLTEVETPIRNEWG | 1486 |
| 369 | SLLTEAETPIRNEWGCRCNDSSD | 1481 |
| 370 | SLLTEVETPIRNEWGERCNDSSD | 1474 |
| 371 | MSLCTEVGMSLLTEV | 1468 |
| 372 | CSLLTEVGMSCLTEV | 1466 |
| 373 | CSLLTECGMSLLTEV | 1458 |
| 374 | SLLTECGCSLLTEC | 1451 |
| 375 | SLLTEVETPIRNEWGCRVNDSSD | 1446 |
| 376 | CSLLTECGMSLLTEC | 1445 |
| 377 | SLKTEVETPIRNEWGCRCNDSSD | 1434 |
| 378 | SLLTECGSLLTEC | 1426 |
| 379 | SLCTEVGCSCLCEV | 1421 |
| 380 | SLLTEVETPIRNTWGCRCNDSSD | 1409 |
| 381 | SLLQEVETPIRNEWGCRCNDSSD | 1399 |
| 382 | CSLLTECGSLLTEV | 1393 |
| 383 | CSLLTEVGCSLLTEC | 1380 |
| 384 | SLLTEVETPIRNEYGCRCNDSSD | 1377 |
| 385 | CSLLTEVGCLCTCV | 1375 |
| 386 | SLLTEVETPIRNEVGCRCNDSSD | 1371 |
| 387 | SLLTEVETPIRTEWGCRCNDSSD | 1365 |
| 388 | CSLLTEVGCLLTEV | 1351 |
| 389 | SLLTEVETPYRNEWGCRCNDSSD | 1350 |
| 390 | CLLTEVGSLLTEV | 1349 |
| 391 | SNLTEVETPIRNEWGCRCNDSSD | 1345 |
| 392 | SLLTEVETPKRNEWGCRCNDSSD | 1342 |
| 393 | SLLTEVETPIRNEWGCRCNLSSD | 1334 |
| 449 | SLNTEVETPIRNEWGCRCNDSSD | 1333 |
| 450 | SLLTEVEHPIRNEWGCRCNDSSD | 1331 |
| 451 | CSLLTEVGMSLLTEC | 1326 |
| 452 | SLLTEVGSLLTEC | 1326 |
| 453 | SLLTEVETPIRNEAGCRCNDSSD | 1311 |
| 454 | SLLTEVETPIMNEWGCRCNDSSD | 1308 |
| 455 | CLCTCVGSLLTEC | 1303 |
| 456 | CSLLTECGMSLLCEV | 1294 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 457 | SLLTEVETPMRNEWGCRCNDSSD | 1281 |
| 458 | CSLLTECGSCLTEV | 1278 |
| 459 | SLITEVETPIRNEWGCRCNDSSD | 1277 |
| 460 | MSLLTECGMSLLCEV | 1268 |
| 461 | SLLTEVETPLRNEWGCRCNDSSD | 1268 |
| 462 | SLLTECGCLLTEV | 1259 |
| 463 | CSLLTECGSLLTCV | 1258 |
| 464 | SLLTEVGSLCTEV | 1256 |
| 465 | SLLTEVETPIRNEWGCRCNKSSD | 1254 |
| 466 | SCLTEVGCSLLTEV | 1250 |
| 467 | SLLTEVENPIRNEWGCRCNDSSD | 1245 |
| 468 | SCLCECGSLLTEC | 1244 |
| 469 | MSLLTECGMSLLTEC | 1236 |
| 470 | MSLLTEVGCSLLTEC | 1227 |
| 471 | SLLTEEETPIRNEWGCRCNDSSD | 1220 |
| 472 | SLLTECGSLCTEV | 1218 |
| 473 | SLSTEVETPIRNEWGCRCNDSSD | 1217 |
| 474 | SLLTECETPIRNEWGCRCNDSSD | 1214 |
| 475 | MSLLTECGMSLCTEV | 1212 |
| 476 | CSLLTEVGCSCLCEV | 1206 |
| 477 | SLLTECGSLLCEV | 1206 |
| 478 | SLTTEVETPIRNEWGCRCNDSSD | 1205 |
| 407 | SLLTEVETPIRNEWGCRCNDHSD | 1200 |
| 479 | SLLTEDETPIRNEWGCRCNDSSD | 1196 |
| 480 | SLLTECGCLCTCV | 1193 |
| 481 | CSLLTECGMSLCTEV | 1187 |
| 482 | CLCTCVGSLLTEV | 1178 |
| 483 | CSLLTECGCSLLTEC | 1177 |
| 484 | SLVTEVETPIRNEWGCRCNDSSD | 1175 |
| 485 | CSLLTECGMCLCTCV | 1168 |
| 486 | SLFTEVETPIRNEWGCRCNDSSD | 1156 |
| 487 | SLLTNVETPIRNEWGCRCNDSSD | 1142 |
| 394 | SLLTEVETPIRNEWGCRCNMSSD | 1133 |
| 488 | SLLTEVETPIHNEWGCRCNDSSD | 1112 |
| 489 | MSLLTECGMCLLTEV | 1111 |
| 490 | SVLTEVETPIRNEWGCRCNDSSD | 1109 |
| 491 | SLLTEVETLIRNEWGCRCNDSSD | 1109 |
| 492 | MSLLTECGMCLCTCV | 1107 |
| 493 | SLLTEVETMIRNEWGCRCNDSSD | 1104 |
| 494 | SLLTEQETPIRNEWGCRCNDSSD | 1102 |
| 495 | SLLTEVETPGRNEWGCRCNDSSD | 1097 |
| 496 | SCLTEVGSLLCEV | 1095 |
| 436 | SLLTEVETPI | 1084 |
| 497 | SLLTECGSCLCEC | 1077 |
| 498 | SLLTEMETPIRNEWGCRCNDSSD | 1076 |
| 499 | CSLLTEVGMSCLCEC | 1066 |
| 500 | SCLTEVGSLLTEV | 1066 |
| 501 | SLLTEVETPIRNEWGCCCNDSSD | 1065 |
| 502 | CSCLCEVGSLLTEC | 1064 |
| 503 | SLLTEVETPIRNEWGCWCNDSSD | 1061 |
| 504 | SLLTEVETPIRNEWGFRCNDSSD | 1057 |
| 505 | SLLTEKETPIRNEWGCRCNDSSD | 1055 |
| 506 | SLCTEVGSLLCEV | 1050 |
| 507 | SLCTEVETPIRNEWGCRCNDSSD | 1050 |
| 508 | MSLCTEVGCSLLTEV | 1049 |
| 509 | SLLTEVETPIYNEWGCRCNDSSD | 1049 |
| 510 | SLRTEVETPIRNEWGCRCNDSSD | 1047 |
| 511 | SLLCEVGCSLLTEV | 1044 |
| 512 | SLLTEVETPIRNQWGCRCNDSSD | 1039 |
| 513 | MCLLTEVGMSLLTEV | 1032 |
| 514 | SLLTEGETPIRNEWGCRCNDSSD | 1029 |
| 515 | SLLTEWETPIRNEWGCRCNDSSD | 1025 |
| 516 | SLLTEVETPIRNEWGCRCPDSSD | 1024 |
| 517 | SLLTEVETPIRNEMGCRCNDSSD | 1020 |
| 518 | SYLTEVETPIRNEWGCRCNDSSD | 1019 |
| 519 | SLLTEVETPIRNEWGCRSNDSSD | 1016 |
| 520 | VLLTEVETPIRNEWGCRCNDSSD | 1014 |
| 437 | SLLTEVETPIR | 1012 |
| 521 | SLLTAVETPIRNEWGCRCNDSSD | 1012 |
| 522 | SLLTMVETPIRNEWGCRCNDSSD | 1011 |
| 523 | SLLTEFETPIRNEWGCRCNDSSD | 1009 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 524 | SLLTEVETPIDNEWGCRCNDSSD | 1001 |
| 401 | SLLTEVETPIRNEWGCRCNWSSD | 999 |
| 525 | SLLTEVGCSCLCEV | 996 |
| 526 | MSLLTECGMSCLCEC | 992 |
| 527 | SLLTEVEQPIRNEWGCRCNDSSD | 986 |
| 528 | MSLLTCVGCSLLTEV | 978 |
| 529 | SLLTEVETNIRNEWGCRCNDSSD | 978 |
| 445 | SLLTEVETPIRNEWGCRCN | 977 |
| 530 | SLLTESETPIRNEWGCRCNDSSD | 974 |
| 433 | SLLTEVETPIRNEWGCRCNDSWD | 971 |
| 531 | MSLCTEVGMSLLTEC | 970 |
| 532 | MSCLTEVGMSLLTEV | 968 |
| 533 | CSLLTEVGSCLCEC | 963 |
| 534 | SLLTEVEKPIRNEWGCRCNDSSD | 963 |
| 535 | SLLTEVETPIRNEWGCRCNFSSD | 963 |
| 408 | SLLTEVETPIRNEWGCRCNDISD | 962 |
| 536 | MCLCTCVGCSLLTEV | 954 |
| 537 | SLLTEVEPPIRNEWGCRCNDSSD | 953 |
| 538 | LLLTEVETPIRNEWGCRCNDSSD | 950 |
| 539 | SLLTEYETPIRNEWGCRCNDSSD | 950 |
| 422 | SLLTEVETPIRNEWGCRCNDSFD | 947 |
| 421 | SLLTEVETPIRNEWGCRCNDSED | 944 |
| 540 | SLLTEHETPIRNEWGCRCNDSSD | 942 |
| 541 | SLLTEVETPIRNEWKCRCNDSSD | 932 |
| 418 | SLLTEVETPIRNEWGCRCNDWSD | 929 |
| 542 | MSLCTEVGMSLLTCV | 927 |
| 395 | SLLTEVETPIRNEWGCRCNNSSD | 926 |
| 543 | MSLLTCVGMSLLTEV | 925 |
| 544 | SLLTEVETPIRNEWGCRCRDSSD | 924 |
| 545 | SLLTEVSTPIRNEWGCRCNDSSD | 923 |
| 546 | SLLTEVETPIRNRWGCRCNDSSD | 921 |
| 547 | SLLTETETPIRNEWGCRCNDSSD | 919 |
| 548 | CSLLTECGSLCTEV | 917 |
| 549 | SLLTEVETFIRNEWGCRCNDSSD | 916 |
| 550 | SLLTENETPIRNEWGCRCNDSSD | 914 |
| 551 | SLLTEVATPIRNEWGCRCNDSSD | 914 |
| 552 | SLLTEVETPIRNEWGCYCNDSSD | 913 |
| 553 | SLLTEVTTPIRNEWGCRCNDSSD | 909 |
| 554 | CLLTEVGSLLTCV | 902 |
| 555 | SLLTEVETPIRNEWGCRCWDSSD | 901 |
| 556 | SLLTELETPIRNEWGCRCNDSSD | 900 |
| 557 | MSCLTEVGCSLLTEV | 899 |
| 435 | SLLTEVETP | 899 |
| 409 | SLLTEVETPIRNEWGCRCNDKSD | 898 |
| 444 | SLLTEVETPIRNEWGCRC | 898 |
| 558 | CSLLTECGMSCLCEC | 897 |
| 559 | SLLTEVETAIRNEWGCRCNDSSD | 895 |
| 560 | SLLTEVETPIRNEWGCRCFDSSD | 894 |
| 561 | SCLTEVETPIRNEWGCRCNDSSD | 892 |
| 562 | SLLTEVETPIRWEWGCRCNDSSD | 890 |
| 398 | SLLTEVETPIRNEWGCRCNRSSD | 890 |
| 563 | SLLTEVETPIRNEWGGRCNDSSD | 887 |
| 564 | SLLTEVLPIRNEWGCRCNDSSD | 886 |
| 565 | SLLTEVETPIRVEWGCRCNDSSD | 884 |
| 566 | SLLTEVCTPIRNEWGCRCNDSSD | 881 |
| 567 | SLLTECGCSCLCEV | 879 |
| 568 | SLLTEVETPIRNEWGCRCQDSSD | 877 |
| 569 | SLLTEVETPIRNEWLCRCNDSSD | 876 |
| 570 | MCLLTEVGCSLLTEV | 875 |
| 571 | SLLTEVETPIRNLWGCRCNDSSD | 870 |
| 572 | SLLTEVETPIRNEKGCRCNDSSD | 868 |
| 573 | SLLTEVETPIRNEWGCRTNDSSD | 867 |
| 574 | CLLTEVGSLLTEC | 866 |
| 575 | SLLTEVRTPIRNEWGCRCNDSSD | 866 |
| 400 | SLLTEVETPIRNEWGCRCNVSSD | 865 |
| 443 | SLLTEVETPIRNEWGCR | 864 |
| 576 | SLLTEVETPIFNEWGCRCNDSSD | 862 |
| 577 | SLLTEVETPIRNIWGCRCNDSSD | 862 |
| 434 | SLLTEVETPIRNEWGCRCNDSYD | 862 |
| 415 | SLLTEVETPIRNEWGCRCNDRSD | 860 |
| 578 | SLLTERETPIRNEWGCRCNDSSD | 859 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 579 | SLLTEVETPIRNEWGCRWNDSSD | 859 |
| 580 | SLCTEVGCSLLTEV | 858 |
| 581 | SLLTEVETYIRNEWGCRCNDSSD | 857 |
| 582 | SLLTEVETPIRAEWGCRCNDSSD | 856 |
| 583 | SLLTEVWTPIRNEWGCRCNDSSD | 855 |
| 584 | SLLTEVETPIRNEWGCRRNDSSD | 855 |
| 585 | SLLTEVETPIRLEWGCRCNDSSD | 853 |
| 586 | SLLTEVETPIRNEWGCRCNISSD | 851 |
| 587 | SLLTEVETPIRCEWGCRCNDSSD | 850 |
| 396 | SLLTEVETPIRNEWGCRCNPSSD | 849 |
| 588 | SLLTEVETPIRNEWGCRCNCSSD | 848 |
| 589 | CSLLTECGMSCLTEV | 846 |
| 590 | SLLTEVEMPIRNEWGCRCNDSSD | 845 |
| 591 | SLLTEVETPHRNEWGCRCNDSSD | 844 |
| 397 | SLLTEVETPIRNEWGCRCNQSSD | 842 |
| 592 | MSLCTEVGCSLLTEC | 840 |
| 593 | SLLTEVEIPIRNEWGCRCNDSSD | 839 |
| 594 | SLLTEVQTPIRNEWGCRCNDSSD | 838 |
| 595 | SLLTEVETPIRNEWGWRCNDSSD | 838 |
| 596 | SLLTEVETPIRNEWFCRCNDSSD | 837 |
| 597 | SLLTEVETGIRNEWGCRCNDSSD | 835 |
| 598 | SLLTEVETPIRNEWGCRKNDSSD | 835 |
| 599 | SLLTEVERPIRNEWGCRCNDSSD | 834 |
| 430 | SLLTEVETPIRNEWGCRCNDSRD | 833 |
| 448 | SLLTEVETPIRNEWGCRCNDSS | 833 |
| 600 | SLLTEVETPIRNEWGLRCNDSSD | 831 |
| 601 | SLLTECGSCLTEV | 830 |
| 602 | SLLTEVETEIRNEWGCRCNDSSD | 828 |
| 603 | SLLTEVETPIRNEWGCRCNGSSD | 828 |
| 604 | SLCTEVGSCLTEV | 824 |
| 605 | SLLTEVETPIRNMWGCRCNDSSD | 820 |
| 606 | SLLTEVETQIRNEWGCRCNDSSD | 819 |
| 607 | SLLTEVESPIRNEWGCRCNDSSD | 817 |
| 447 | SLLTEVETPIRNEWGCRCNDS | 817 |
| 608 | SLLTEIETPIRNEWGCRCNDSSD | 816 |
| 609 | SLLTEVETHIRNEWGCRCNDSSD | 816 |
| 610 | SLLTEVETDIRNEWGCRCNDSSD | 813 |
| 611 | SLLTEVETRIRNEWGCRCNDSSD | 813 |
| 612 | SLLTEVETPIRNEWGCRCIDSSD | 812 |
| 613 | SLLTEVETPIRNEWGCRCNHSSD | 812 |
| 614 | SLLTEVETVIRNEWGCRCNDSSD | 810 |
| 615 | SLLTEVETPIRNEWGCDCNDSSD | 810 |
| 616 | SLLTEVETPIRNPWGCRCNDSSD | 808 |
| 617 | SLLTEVETPIRNSWGCRCNDSSD | 807 |
| 618 | SLLTEVETPIRNEWGCRCLDSSD | 807 |
| 619 | SLLTEVETPIRNEWGCRCNASSD | 807 |
| 620 | SLLTEVETPIRFEWGCRCNDSSD | 806 |
| 621 | SLLTEVEFPIRNEWGCRCNDSSD | 805 |
| 622 | SLLTEVETPIRMEWGCRCNDSSD | 805 |
| 623 | SLLTEVETCIRNEWGCRCNDSSD | 800 |
| 624 | SLLTEVETPIRNEWVCRCNDSSD | 799 |
| 413 | SLLTEVETPIRNEWGCRCNDPSD | 797 |
| 399 | SLLTEVETPIRNEWGCRCNTSSD | 795 |
| 625 | SLLTEVETPIRNEWYCRCNDSSD | 794 |
| 416 | SLLTEVETPIRNEWGCRCNDTSD | 794 |
| 626 | SLLTEVETPIRNEWGCRCYDSSD | 791 |
| 627 | SLLTEVETPIRIEWGCRCNDSSD | 789 |
| 406 | SLLTEVETPIRNEWGCRCNDFSD | 788 |
| 628 | SLLTEVETPIRNEWGCRCMDSSD | 786 |
| 629 | SLLTEVMTPIRNEWGCRCNDSSD | 783 |
| 630 | SLLTEVETPERNEWGCRCNDSSD | 783 |
| 631 | SLLTEVETPIRKEWGCRCNDSSD | 782 |
| 423 | SLLTEVETPIRNEWGCRCNDSHD | 782 |
| 426 | SLLTEVETPIRNEWGCRCNDSLD | 779 |
| 632 | SLLTEVETPIRNEWGCRCVDSSD | 775 |
| 633 | SLLTEVETPIRNEWHCRCNDSSD | 772 |
| 403 | SLLTEVETPIRNEWGCRCNDCSD | 772 |
| 417 | SLLTEVETPIRNEWGCRCNDVSD | 772 |
| 428 | SLLTEVETPIRNEWGCRCNDSPD | 772 |
| 634 | SLLTEVETPIRNEWGCRANDSSD | 770 |
| 425 | SLLTEVETPIRNEWGCRCNDSKD | 770 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
| --- | --- | --- |
| 635 | SLLTEVEAPIRNEWGCRCNDSSD | 769 |
| 410 | SLLTEVETPIRNEWGCRCNDLSD | 769 |
| 636 | SLLTEVETPIRNEIGCRCNDSSD | 768 |
| 637 | SLLTEVETPIRNENGCRCNDSSD | 768 |
| 638 | SLLTEVETPIRNEWGTRCNDSSD | 767 |
| 639 | SLLTEVETPIRNEWGCFCNDSSD | 767 |
| 640 | SLLTEVETPIRNKWGCRCNDSSD | 765 |
| 641 | SLLTEVETPIRNELGCRCNDSSD | 765 |
| 642 | SLLTEVETPIRNEWMCRCNDSSD | 765 |
| 643 | SLLTEVETPIRNGWGCRCNDSSD | 764 |
| 644 | SLLTEVETPIRNEWGVRCNDSSD | 764 |
| 645 | SLLTEVVTPIRNEWGCRCNDSSD | 763 |
| 646 | SLLTEVEGPIRNEWGCRCNDSSD | 763 |
| 647 | SLLTEVETPIRNEWGHRCNDSSD | 763 |
| 648 | SLLTEVETPIRNEWGKRCNDSSD | 762 |
| 649 | SLLTEVETTIRNEWGCRCNDSSD | 760 |
| 650 | SLLTEVETPVRNEWGCRCNDSSD | 758 |
| 651 | SLLTEVETPIRNEWGCRCHDSSD | 758 |
| 652 | SLLTEVEEPIRNEWGCRCNDSSD | 757 |
| 653 | SLLTEVETIIRNEWGCRCNDSSD | 756 |
| 654 | SLLTEVETPIRYEWGCRCNDSSD | 755 |
| 655 | SLYTEVETPIRNEWGCRCNDSSD | 753 |
| 656 | SLLTEVETPIWNEWGCRCNDSSD | 753 |
| 657 | SLLTEVDTPIRNEWGCRCNDSSD | 751 |
| 658 | SLLTEVYTPIRNEWGCRCNDSSD | 751 |
| 438 | SLLTEVETPIRN | 751 |
| 659 | SLLTEVETPIRNEWGARCNDSSD | 750 |
| 440 | SLLTEVETPIRNEW | 750 |
| 660 | SLLTEVETPDRNEWGCRCNDSSD | 749 |
| 661 | SLLTEVETPIRQEWGCRCNDSSD | 748 |
| 662 | SLLTEVETPIRNFWGCRCNDSSD | 747 |
| 663 | MCLCTCVGMSLLTEV | 746 |
| 664 | SLLTEVETPIRNEWGNRCNDSSD | 746 |
| 665 | SLLTEVETPFRNEWGCRCNDSSD | 745 |
| 411 | SLLTEVETPIRNEWGCRCNDMSD | 744 |
| 666 | SLLTEVETPIRNAWGCRCNDSSD | 743 |
| 667 | SLLTEVETPIRNEWGIRCNDSSD | 739 |
| 668 | SLLTEVETPIRNEWGYRCNDSSD | 739 |
| 414 | SLLTEVETPIRNEWGCRCNDQSD | 739 |
| 669 | SLLTEVETPIRNEWTCRCNDSSD | 738 |
| 446 | SLLTEVETPIRNEWGCRCND | 738 |
| 670 | SLLTEVETWIRNEWGCRCNDSSD | 736 |
| 671 | SLLTEVETPIRNEPGCRCNDSSD | 735 |
| 672 | SLLTEVETPIRNEWGRRCNDSSD | 735 |
| 673 | SLLTEVETPSRNEWGCRCNDSSD | 733 |
| 674 | SLLTEVETPIRNEWGCRCTDSSD | 733 |
| 675 | SLLTEVNTPIRNEWGCRCNDSSD | 732 |
| 676 | SLLTEVETPIENEWGCRCNDSSD | 731 |
| 677 | SLLTEVETPIQNEWGCRCNDSSD | 731 |
| 678 | SLLTEVETPIRSEWGCRCNDSSD | 730 |
| 679 | SLLTEVETPIRNEWGCECNDSSD | 730 |
| 680 | SLLTEVETPIVNEWGCRCNDSSD | 729 |
| 681 | SLLTEVETPIRNEWACRCNDSSD | 729 |
| 682 | SLLTEVETPIRNEWGSRCNDSSD | 729 |
| 683 | SLLTEVETPIRNEWGCACNDSSD | 729 |
| 684 | SLLTEVETPIRNHWGCRCNDSSD | 728 |
| 685 | SLLTEVETPIRNVWGCRCNDSSD | 728 |
| 686 | SLLTEVETPIRNEWGCRLNDSSD | 728 |
| 432 | SLLTEVETPIRNEWGCRCNDSVD | 728 |
| 420 | SLLTEVETPIRNEWGCRCNDSCD | 725 |
| 687 | SLLTEVETPCRNEWGCRCNDSSD | 724 |
| 688 | SLLTEVETPIRNETGCRCNDSSD | 724 |
| 689 | SLLTEVETPIRNEWGCRCGDSSD | 724 |
| 690 | SLLTEVHTPIRNEWGCRCNDSSD | 722 |
| 691 | SLLTEVETPIRNEWGCRMNDSSD | 722 |
| 692 | SLLTEVETPILNEWGCRCNDSSD | 721 |
| 693 | SLLTEVETPWRNEWGCRCNDSSD | 720 |
| 694 | SLLTEVETPIRNEWGCRCNESSD | 720 |
| 695 | SLLTEVEVPIRNEWGCRCNDSSD | 719 |
| 696 | SLLTEVETPIRNEHGCRCNDSSD | 719 |
| 697 | SLLTEVETPIRNEWGCRINDSSD | 718 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 698 | SLLTEVETPIRDEWGCRCNDSSD | 716 |
| 699 | SLLTEVETPIRNEWGCRYNDSSD | 716 |
| 700 | SLLTEVETSIRNEWGCRCNDSSD | 715 |
| 701 | SLLTEVETPIRNEWGCKCNDSSD | 715 |
| 702 | SLLTEVETPIRNYWGCRCNDSSD | 714 |
| 703 | SLLTEVETPIRNWWGCRCNDSSD | 713 |
| 704 | SLLTEVETPIRNEWRCRCNDSSD | 713 |
| 705 | SLLTEVKTPIRNEWGCRCNDSSD | 712 |
| 706 | SLLTEVETPIRNEWGCRCADSSD | 712 |
| 707 | SLLTEVETPIANEWGCRCNDSSD | 708 |
| 708 | SLLTEVETPIRNEGGCRCNDSSD | 708 |
| 412 | SLLTEVETPIRNEWGCRCNDNSD | 708 |
| 709 | SLLTEVLTPIRNEWGCRCNDSSD | 707 |
| 710 | SLLTEVETPIRREWGCRCNDSSD | 707 |
| 711 | CSLLTEVGSLCTEV | 707 |
| 712 | SLLTEVETPIRNDWGCRCNDSSD | 706 |
| 713 | SLLTEVETPIRNEWGQRCNDSSD | 705 |
| 714 | SLLTEVETPIRNEWCCRCNDSSD | 704 |
| 715 | SLLTEVETPARNEWGCRCNDSSD | 702 |
| 716 | SLLTEVETPIRNEFGCRCNDSSD | 702 |
| 717 | SLLTEVETPIRNEWDCRCNDSSD | 701 |
| 431 | SLLTEVETPIRNEWGCRCNDSTD | 701 |
| 718 | SLLTEVECPIRNEWGCRCNDSSD | 700 |
| 719 | SLLTEVETPIRNEWGCTCNDSSD | 700 |
| 720 | SLLTEVETPIINEWGCRCNDSSD | 699 |
| 721 | SLLTEVETPIRHEWGCRCNDSSD | 699 |
| 722 | SLLTEVETPIRNEWGCICNDSSD | 699 |
| 723 | SLLTEVETPIRNEWGCRFNDSSD | 698 |
| 724 | MCLLTEVGMSLLTEC | 697 |
| 725 | SLLTEVETPICNEWGCRCNDSSD | 697 |
| 726 | SLLTEVETPIRNEWECRCNDSSD | 697 |
| 727 | SLLTEVETPIRNEWGPRCNDSSD | 696 |
| 728 | SLLTEVETPIRNEWGCRCCDSSD | 696 |
| 729 | SLLTEVETPIRNEWGCRCSDSSD | 696 |
| 730 | SLLTEVETPIRNEWGCMCNDSSD | 695 |
| 429 | SLLTEVETPIRNEWGCRCNDSQD | 695 |
| 731 | SLLTEVFTPIRNEWGCRCNDSSD | 694 |
| 732 | SLLTEVETPIRNEWGMRCNDSSD | 693 |
| 733 | SLLTEVETPIRNCWGCRCNDSSD | 692 |
| 734 | SLLTEVETPIRNEWGCRHNDSSD | 692 |
| 424 | SLLTEVETPIRNEWGCRCNDSID | 692 |
| 735 | SLLTEVETPIRNEWSCRCNDSSD | 691 |
| 736 | SLLTEVETPIRNEWGCSCNDSSD | 691 |
| 737 | SLLTEVETPIRNERGCRCNDSSD | 690 |
| 738 | SLLTEVETPPRNEWGCRCNDSSD | 689 |
| 739 | SLLTEVETPIRNEWGCRCEDSSD | 687 |
| 740 | SHLTEVETPIRNEWGCRCNDSSD | 686 |
| 741 | SLLTEVETPIRNNWGCRCNDSSD | 686 |
| 742 | SLLTEVETPIRNEWGCVCNDSSD | 684 |
| 404 | SLLTEVETPIRNEWGCRCNDDSD | 684 |
| 743 | SLLTEVETPIRNEWGCNCNDSSD | 683 |
| 402 | SLLTEVETPIRNEWGCRCNDASD | 683 |
| 744 | SLLTEVETPIGNEWGCRCNDSSD | 681 |
| 745 | SLLTEVETPIRNESGCRCNDSSD | 681 |
| 746 | SLLTEVETPIRNEWGCRNNDSSD | 681 |
| 747 | SLCTEVGCSLLTEC | 680 |
| 748 | SLLTEVETPIRNEWGCLCNDSSD | 680 |
| 442 | SLLTEVETPIRNEWGC | 680 |
| 749 | MSLLCEVGMSLLTEV | 677 |
| 750 | SLLTEVETPRRNEWGCRCNDSSD | 677 |
| 405 | SLLTEVETPIRNEWGCRCNDESD | 676 |
| 751 | SLLTEVETPIRNEDGCRCNDSSD | 675 |
| 752 | SLLTEVETPIRNEWGCRGNDSSD | 674 |
| 753 | SLLTEVETPIRPEWGCRCNDSSD | 673 |
| 754 | SLLTEVETPISNEWGCRCNDSSD | 672 |
| 755 | SLLTQVETPIRNEWGCRCNDSSD | 671 |
| 756 | SLLTEVETPIRNEWGCQCNDSSD | 671 |
| 757 | SLLTEVETPIRNEWGCRPNDSSD | 669 |
| 758 | SLLTEVETPTRNEWGCRCNDSSD | 668 |
| 427 | SLLTEVETPIRNEWGCRCNDSMD | 668 |
| 759 | SLHTEVETPIRNEWGCRCNDSSD | 667 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 760 | SLLTEVETPIRNEWQCRCNDSSD | 667 |
| 761 | MSLLTEVGCSCLCEV | 663 |
| 762 | SLLTEVETPIRNEWGCRCDDSSD | 662 |
| 763 | SLLTEVEWPIRNEWGCRCNDSSD | 660 |
| 764 | SLLTEPETPIRNEWGCRCNDSSD | 659 |
| 765 | SLLTEVETPIRNEQGCRCNDSSD | 657 |
| 766 | SLLTEVETPITNEWGCRCNDSSD | 653 |
| 767 | SLLTEVETPIRNEWGCPCNDSSD | 653 |
| 768 | MSCLTEVGMSLLTEC | 650 |
| 769 | MCLLTEVGCSLLTEC | 650 |
| 770 | SLLTEVETPNRNEWGCRCNDSSD | 649 |
| 771 | SLLTEVETPIREEWGCRCNDSSD | 648 |
| 772 | SLLTEVETPIRNEWGCRQNDSSD | 646 |
| 773 | SLLTEVETPIRGEWGCRCNDSSD | 644 |
| 774 | SLLTEVETPIRNEWPCRCNDSSD | 644 |
| 775 | SLLTEVETPIRNEWGCGCNDSSD | 644 |
| 776 | SLLTEVETPIRNEWGCHCNDSSD | 640 |
| 777 | SLLTEVPTPIRNEWGCRCNDSSD | 639 |
| 419 | SLLTEVETPIRNEWGCRCNDSAD | 639 |
| 778 | SLLTEVETPIKNEWGCRCNDSSD | 638 |
| 779 | SLLTEVEDPIRNEWGCRCNDSSD | 635 |
| 780 | SLLTEVETPINNEWGCRCNDSSD | 632 |
| 781 | MSLLCEVGCSLLTEV | 631 |
| 782 | SLLTEVETPQRNEWGCRCNDSSD | 630 |
| 783 | SLLTEVEYPIRNEWGCRCNDSSD | 628 |
| 784 | SLLTEVGTPIRNEWGCRCNDSSD | 627 |
| 785 | SLLTEVETPIRNEWNCRCNDSSD | 618 |
| 786 | SWLTEVETPIRNEWGCRCNDSSD | 615 |
| 787 | SLLTEVETPIRNEEGCRCNDSSD | 613 |
| 788 | SQLTEVETPIRNEWGCRCNDSSD | 609 |
| 789 | SLCTEVGSLCTEV | 607 |
| 790 | SLLTEVETPIRNEWGDRCNDSSD | 603 |
| 791 | MSLCTEVGMCLLTEV | 597 |
| 792 | CSLLTEVGSLLCEV | 593 |
| 793 | MSLLTEVGMSLLCEV | 591 |
| 794 | SLLTEVETPIRNEWGCRDNDSSD | 589 |
| 795 | SLLTEVITPIRNEWGCRCNDSSD | 587 |
| 796 | SLLTEVETPIRNEWGCRENDSSD | 579 |
| 797 | SCLTEVGSLLTCV | 573 |
| 798 | CLCTCVGCSLLTEV | 567 |
| 799 | MSCLTEVGCSLLTEC | 557 |
| 800 | MSLLTECGCSCLCEV | 556 |
| 801 | MSLLTECGMSCLTEV | 554 |
| 802 | SLGTEVETPIRNEWGCRCNDSSD | 542 |
| 803 | SLLSEVETPIRNEWGCRCNDSSD | 532 |
| 804 | SLWTEVETPIRNEWGCRCNDSSD | 525 |
| 805 | MSLLTCVGMSLLTEC | 524 |
| 806 | SLCTEVGCLLTEV | 522 |
| 807 | CLLTEVGCSLLTEV | 520 |
| 808 | SCLTEVGCSLLTEC | 514 |
| 809 | CSLLTECGCLLTEV | 507 |
| 810 | SLLTCVGCSLLTEV | 504 |
| 811 | CSLLTECGCLCTCV | 458 |
| 812 | SLLTCVGCSLLTEC | 447 |
| 813 | CSLLTECGSLLTEC | 441 |
| 814 | CSLLTECGSLLCEV | 430 |
| 815 | CSLLTECGSCLCEC | 419 |
| 816 | CLLTEVGCSLLTEC | 409 |
| 817 | CSLLTECGCSCLCEV | 404 |
| 818 | MSLLTECGCSLLTEC | 386 |
| 819 | CLCTCVGCSLLTEC | 340 |
| 820 | MSLLTCVGCSLLTEC | 330 |
| 821 | CSCLCEVGCSLLTEV | 325 |
| 822 | SLLTDVETPIRNEWGCRCNDSSD | 324 |
| 823 | SCLTEVGSLLTEC | 321 |
| 824 | SLLTCVGSLLTEV | 320 |
| 825 | MSLLCEVGMSLLTEC | 314 |
| 826 | MSLLCEVGCSLLTEC | 312 |
| 827 | MSCLCECGCSLLTEV | 306 |
| 828 | MCLCTCVGMSLLTEC | 306 |
| 829 | MSLLTEVGMSCLCEC | 304 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 830 | 1CSLLTEVETP1SLLTEVETPCLLTEVETPI1 | 2303 |
| 831 | 1CSLLTEVETP1SLLTEVETPCSLLTEVETP1 | 2147 |
| 832 | 1CLTEVETPIR1SLLTEVETPCLLTEVETPI1 | 2145 |
| 833 | SLLTEVETCSLLTEVETATPIRNEWGCRC | 2133 |
| 834 | SLLTEVET1CSLLTEVET1SLLTEVETCEWG1R | 2107 |
| 835 | SLLTEVET1CSLLTEVET1SLLTEVETAWGCR1 | 2103 |
| 836 | 1CLTEVETPIR1SLLTEVETPCSLLTEVETP1 | 1936 |
| 837 | 1CETPIRNEWG1SLLTEVETPCLLTEVETPI1 | 1912 |
| 838 | 1CTEVETPIRN1SLLTEVETPCLLTEVETPI1 | 1887 |
| 839 | 1CTEVETPIRN1SLLTEVETPCSLLTEVETP1 | 1796 |
| 840 | SLLTEVET1CSLLTEVET1SLLTEVETCEWGSR1 | 1765 |
| 841 | 1CSLLTEVETP1LTEVETPIRCSLLTEVETP1 | 1732 |
| 842 | 1CSLLTEVETP1TEVETPIRNCSLLTEVETP1 | 1717 |
| 843 | 1CVETPIRNEW1SLLTEVETPCLTEVETPIR1 | 1715 |
| 844 | SLLTEVET1CSLLTEVET1SLLTEVETAGCR1N | 1712 |
| 845 | 1CSLLTEVETP1SLLTEVETPCETPIRNEWG1 | 1704 |
| 846 | SLLTEVETCSLLTEVETCNEWGSRSNDSSC | 1697 |
| 847 | 1CLLTEVETPI1SLLTEVETPCLLTEVETPI1 | 1665 |
| 848 | 1CEVETPIRNE1SLLTEVETPCSLLTEVETP1 | 1655 |
| 849 | 1CLLTEVETPI1LTEVETPIRCSLLTEVETP1 | 1651 |
| 850 | 1CSLLTEVETP1SLLTEVETPCVETPIRNEW1 | 1649 |
| 851 | 1CSLLTEVETP1VETPIRNEWCSLLTEVETP1 | 1634 |
| 852 | SLLTEVET1CSLLTEVET1SLLTEVETCIRNEW1 | 1598 |
| 853 | SLLTEVET1CSLLTEVET1SLLTEVETCLLTEV1 | 1592 |
| 854 | 1CTEVETPIRN1LTEVETPIRCSLLTEVETP1 | 1590 |
| 855 | 1CEVETPIRNE1SLLTEVETPCLLTEVETPI1 | 1584 |
| 856 | SLLTEVETCSLLTEVETCVETPIRNEWGC | 1584 |
| 857 | 1CLTEVETPIR1SLLTEVETPCLTEVETPIR1 | 1576 |
| 858 | 1CETPIRNEWG1SLLTEVETPCSLLTEVETP1 | 1559 |
| 859 | 1CSLLTEVETP1SLLTEVETPCLTEVETPIR1 | 1552 |
| 860 | 1CVETPIRNEW1SLLTEVETPCSLLTEVETP1 | 1531 |
| 861 | SLLTEVET1CSLLTEVET1SLLTEVETCSLLTE1 | 1490 |
| 862 | SLLTEVET1CSLLTEVET1SLLTEVETCTPIRN1 | 1481 |
| 863 | 1CLTEVETPIR1LTEVETPIRCSLLTEVETP1 | 1458 |
| 864 | 1CTEVETPIRN1SLLTEVETPCLTEVETPIR1 | 1452 |
| 865 | SLLTEVETCSLLTEVETAEWGCRCNDSSD | 1451 |
| 866 | 1CVETPIRNEW1SLLTEVETPCETPIRNEWG1 | 1446 |
| 867 | 1CLLTEVETPI1SLLTEVETPCSLLTEVETP1 | 1438 |
| 868 | 1CEVETPIRNE1SLLTEVETPCETPIRNEWG1 | 1425 |
| 869 | 1CSLLTEVETP1EVETPIRNECSLLTEVETP1 | 1405 |
| 870 | 1CEVETPIRNE1EVETPIRNECSLLTEVETP1 | 1400 |
| 871 | 1CVETPIRNEW1SLLTEVETPCLLTEVETPI1 | 1396 |
| 872 | 1CEVETPIRNE1LTEVETPIRCSLLTEVETP1 | 1382 |
| 873 | 1CSLLTEVETP1VETPIRNEWCLLTEVETPI1 | 1382 |
| 874 | SLLTEVETCSLLTEVETCEWGSRSNDSSDC | 1375 |
| 875 | SLLTEVETCSLLTEVETCSLLTEVETPIRC | 1369 |
| 876 | 1CVETPIRNEW1LTEVETPIRCSLLTEVETP1 | 1327 |
| 877 | 1CVETPIRNEW1ETPIRNEWGCSLLTEVETP1 | 1317 |
| 878 | 1CSLLTEVETP1TEVETPIRNCLLTEVETPI1 | 1313 |
| 879 | SLLTEVETCSLLTEVETCETPIRNEWGCR | 1306 |
| 880 | 1CLTEVETPIR1TEVETPIRNCSLLTEVETP1 | 1290 |
| 881 | CSLLTEVETPIRNEWGCETPIRNEWGSRSNDSC | 1289 |
| 882 | 1CETPIRNEWG1LTEVETPIRCSLLTEVETP1 | 1286 |
| 883 | 1CLLTEVETPI1TEVETPIRNCSLLTEVETP1 | 1270 |
| 884 | SLLTEVETCSLLTEVETCRNEWGSRSNDSC | 1255 |
| 885 | 1CSLLTEVETP1ETPIRNEWGCSLLTEVETP1 | 1250 |
| 886 | 1CSLLTEVETP1LTEVETPIRCLTEVETPIR1 | 1241 |
| 887 | 1CTEVETPIRN1TEVETPIRNCSLLTEVETP1 | 1229 |
| 888 | CSLLTEVETCPIRNEWGSRSNDSSDC | 1224 |
| 889 | 1CSLLTEVETP1EVETPIRNECLLTEVETPI1 | 1221 |
| 890 | SLLTEVET1CSLLTEVET1SLLTEVETCETPIR1 | 1208 |
| 891 | CSLLTEVETPIRNCETPIRNEWGSRSNDSC | 1204 |
| 892 | 1CSLLTEVETP1LLTEVETPICLTEVETPIR1 | 1203 |
| 893 | SLLTEVET1CSLLTEVET1SLLTEVETCVETPI1 | 1200 |
| 894 | CSLLTEVETCTPIRNEWGSRSNDSSC | 1196 |
| 895 | SLLTEVET1CSLLTEVET1SLLTEVETCRNEWG1 | 1195 |
| 896 | 1CETPIRNEWG1ETPIRNEWGCSLLTEVETP1 | 1180 |
| 897 | 1CEVETPIRNE1SLLTEVETPCLTEVETPIR1 | 1169 |
| 898 | SLLTEVET1CSLLTEVET1SLLTEVETACR1ND | 1169 |
| 899 | SLLTEVETCSLLTEVETAPIRNEWGCRCN | 1165 |
| 900 | 1CSLLTEVETP1LLTEVETPICSLLTEVETP1 | 1157 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 901 | SLLTEVET1CSLLTEVET1SLLTEVETCLTEVE1 | 1144 |
| 902 | 1CLTEVETPIR1ETPIRNEWGCSLLTEVETP1 | 1125 |
| 903 | 1CEVETPIRNE1ETPIRNEWGCSLLTEVETP1 | 1124 |
| 904 | SLLTEVETCSLLTEVETAIRNEWGCRCND | 1120 |
| 905 | CSLLTEVETPICETPIRNEWGSRSNDSC | 1120 |
| 906 | CSLLTEVETPIRNEWGCPIRNEWGSRSNDSSDC | 1118 |
| 907 | SLLTEVET1CSLLTEVET1SLLTEVETCPIRNE1 | 1104 |
| 908 | SLLTEVET1CSLLTEVET1SLLTEVETCNEWG1 | 1103 |
| 909 | SLLTEVETCSLLTEVETCLLTEVETPIRNC | 1101 |
| 910 | 1CETPIRNEWG1SLLTEVETPCLTEVETPIR1 | 1099 |
| 911 | CSLLTEVETPIRCETPIRNEWGSRSNDSC | 1087 |
| 912 | SLLTEVETCSLLTEVETCTPIRNEWGSRSC | 1081 |
| 913 | 1CTEVETPIRN1SLLTEVETPCEVETPIRNE1 | 1079 |
| 914 | SLLTEVET1CSLLTEVET1SLLTEVETCEVETP1 | 1062 |
| 915 | SLLTEVET1CSLLTEVET1SLLTEVETCTEVET1 | 1053 |
| 916 | 1CSLLTEVETP1LTEVETPIRCLLTEVETPI1 | 1048 |
| 917 | CSLLTEVETPIRNECETPIRNEWGSRSNDSC | 1037 |
| 918 | 1CSLLTEVETP1SLLTEVETPCTEVETPIRN1 | 1022 |
| 919 | 1CETPIRNEWG1TEVETPIRNCSLLTEVETP1 | 1021 |
| 920 | CSLLTEVETPIRNECTPIRNEWGSRSNDSSC | 1019 |
| 921 | 1CEVETPIRNE1TEVETPIRNCSLLTEVETP1 | 1014 |
| 922 | CSLLTEVETPCETPIRNEWGSRSNDSC | 1010 |
| 923 | 1CSLLTEVETP1LLTEVETPICLLTEVETPI1 | 1009 |
| 924 | CSLLTEVETPIRCTPIRNEWGSRSNDSSC | 1000 |
| 925 | SLLTEVETCSLLTEVETCVETPIRNEWGSC | 979 |
| 926 | SLLTEVETCSLLTEVETARNEWGCRCNDS | 963 |
| 927 | SLLTEVETCSLLTEVETCETPIRNEWGSRC | 935 |
| 928 | SLLTEVETCSLLTEVETANEWGCRCNDSS | 897 |
| 929 | 1CETPIRNEWG1VETPIRNEWCSLLTEVETP1 | 890 |
| 930 | SLLTEVETCSLLTEVETCEVETPIRNEWGC | 867 |
| 931 | CSLLTEVETPCPIRNEWGSRSNDSSDC | 853 |
| 932 | 1CLTEVETPIR1VETPIRNEWCSLLTEVETP1 | 852 |
| 933 | SLLTEVETCSLLTEVETCPIRNEWGSRSNC | 840 |
| 934 | 1CEVETPIRNE1VETPIRNEWCSLLTEVETP1 | 834 |
| 935 | 1CVETPIRNEW1SLLTEVETPCVETPIRNEW1 | 815 |
| 936 | 1CETPIRNEWG1EVETPIRNECSLLTEVETP1 | 809 |
| 937 | 1CSLLTEVETP1ETPIRNEWGCLLTEVETPI1 | 805 |
| 938 | CSLLTEVETCETPIRNEWGSRSNDSC | 796 |
| 939 | 1CSLLTEVETP1LLTEVETPICETPIRNEWG1 | 777 |
| 940 | SLLTEVETCSLLTEVETCTEVETPIRNEWC | 775 |
| 941 | 1CEVETPIRNE1SLLTEVETPCTEVETPIRN1 | 772 |
| 942 | 1CETPIRNEWG1SLLTEVETPCTEVETPIRN1 | 749 |
| 943 | 1CLLTEVETPI1VETPIRNEWCSLLTEVETP1 | 743 |
| 944 | 1CSLLTEVETP1TEVETPIRNCLTEVETPIR1 | 740 |
| 945 | 1CLTEVETPIR1SLLTEVETPCVETPIRNEW1 | 733 |
| 946 | 1CLTEVETPIR1SLLTEVETPCTEVETPIRN1 | 729 |
| 947 | 1CVETPIRNEW1SLLTEVETPCTEVETPIRN1 | 724 |
| 948 | SLLTEVETCSLLTEVETCIRNEWGSRSNDC | 721 |
| 949 | 1CLLTEVETPI1SLLTEVETPCLTEVETPIR1 | 717 |
| 950 | 1CETPIRNEWG1SLLTEVETPCVETPIRNEW1 | 715 |
| 951 | 1CTEVETPIRN1SLLTEVETPCVETPIRNEW1 | 711 |
| 952 | 1CTEVETPIRN1VETPIRNEWCSLLTEVETP1 | 710 |
| 953 | 1CVETPIRNEW1TEVETPIRNCSLLTEVETP1 | 708 |
| 954 | CSLLTEVETPICPIRNEWGSRSNDSSDC | 700 |
| 955 | 1CVETPIRNEW1VETPIRNEWCSLLTEVETP1 | 699 |
| 956 | 1CTEVETPIRN1SLLTEVETPCETPIRNEWG1 | 691 |
| 957 | 1CTEVETPIRN1SLLTEVETPCTEVETPIRN1 | 684 |
| 958 | 1CSLLTEVETP1SLLTEVETPCEVETPIRNE1 | 684 |
| 959 | 1CEVETPIRNE1SLLTEVETPCVETPIRNEW1 | 674 |
| 960 | SLLTEVETCSLLTEVETCLTEVETPIRNEC | 666 |
| 961 | 1CLTEVETPIR1EVETPIRNECSLLTEVETP1 | 665 |
| 962 | 1CLTEVETPIR1SLLTEVETPCETPIRNEWG1 | 657 |
| 963 | 1CVETPIRNEW1EVETPIRNECSLLTEVETP1 | 652 |
| 964 | 1CETPIRNEWG1SLLTEVETPCETPIRNEWG1 | 645 |
| 965 | CSLLTEVETPCTPIRNEWGSRSNDSSC | 645 |
| 966 | CSLLTEVETPICTPIRNEWGSRSNDSSC | 622 |
| 967 | 1CLLTEVETPI1EVETPIRNECSLLTEVETP1 | 617 |
| 968 | 1CLLTEVETPI1ETPIRNEWGCSLLTEVETP1 | 608 |
| 969 | CSLLTEVETPIRCPIRNEWGSRSNDSSDC | 606 |
| 970 | CSLLTEVETPIRNCPIRNEWGSRSNDSSDC | 589 |
| 971 | 1CSLLTEVETP1LTEVETPIRCTEVETPIRN1 | 571 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 972 | 1CSLLTEVETP1LTEVETPIRCETPIRNEWG1 | 564 |
| 973 | CSLLTEVETPIRNECPIRNEWGSRSNDSSDC | 553 |
| 974 | 1CSLLTEVETP1LLTEVETPICVETPIRNEW1 | 551 |
| 975 | 1CLLTEVETPI1SLLTEVETPCVETPIRNEW1 | 539 |
| 976 | 1CLTEVETPIR1SLLTEVETPCEVETPIRNE1 | 538 |
| 977 | 1CVETPIRNEW1LLTEVETPICSLLTEVETP1 | 537 |
| 978 | 1CTEVETPIRN1EVETPIRNECSLLTEVETP1 | 535 |
| 979 | CSLLTEVETPIRNCTPIRNEWGSRSNDSSC | 532 |
| 980 | CSLLTEVETPIRNEWGCTPIRNEWGSRSNDSSC | 508 |
| 981 | 1CSLLTEVETP1TEVETPIRNCTEVETPIRN1 | 505 |
| 982 | 1CTEVETPIRN1ETPIRNEWGCSLLTEVETP1 | 504 |
| 983 | SLLTEVET1CSLLTEVET1SLLTEVETCNEWGS1 | 346 |
| 984 | CSLLTEVETPIRNC | 2154 |
| 985 | SLLTEVCTCIRNEWG | 2047 |
| 986 | SLLTEVETCSLLTEVETPIRNEWGSRC | 1883 |
| 987 | SLLTEVCTPICNEWG | 1857 |
| 988 | SLLTEVCTPIRCEWG | 1853 |
| 989 | SLLTEVECPIRCEWG | 1849 |
| 990 | CSLLTEVCTPIRNE | 1721 |
| 991 | SLLTEVETCIRNEWGC | 1707 |
| 992 | SLLTEVETCIRNCWG | 1691 |
| 993 | SLLTEVETCCRNEWG | 1675 |
| 994 | SLLTEVETPIRCCWG | 1674 |
| 995 | SLLTEVETSLLTEVETPIRNEWGCRCND | 1663 |
| 996 | SLLTEVCTPCRNEWG | 1551 |
| 997 | CSLLTEVETPIRCE | 1512 |
| 998 | SLLTEVETCIRCEWG | 1495 |
| 999 | SLLTEVETCSLLTEVETPIRNEWGSRSC | 1488 |
| 1000 | SLLTEVCTPIRNCWG | 1440 |
| 1001 | SLLTEVECPIRNCWG | 1438 |
| 1002 | SLCTEVETCIRNEWG | 1385 |
| 1003 | SLLTECETCIRNEWG | 1384 |
| 1004 | SLLTEVECCIRNEWG | 1377 |
| 1005 | SLLTEVETPCRNCWG | 1377 |
| 1006 | SLLTEVETCICNEWG | 1360 |
| 1007 | SLLTEVECPIRNC | 1341 |
| 1008 | SLLTECETPIRNCWG | 1298 |
| 1009 | SLLTEVETCIRNEWG | 1286 |
| 1010 | SLLTEVETPICNCWG | 1255 |
| 1011 | SLLTEVETCSLLTEVETPIRNEWGSRSNC | 1239 |
| 1012 | CSLLTEVETPICNE | 1232 |
| 1013 | CSLLTEVETCIRNE | 1220 |
| 1014 | SLLTEVCCPIRNEWG | 1195 |
| 1015 | SLLTEVETPIRNCWGC | 1177 |
| 1016 | SLLTEVCTPIRNC | 1163 |
| 1017 | SLLTEVECPIRNEWC | 1161 |
| 1018 | CSLLTEVETPIRNE | 1159 |
| 1019 | SLLTEVCTPIRNEWG | 1156 |
| 1020 | CSLLTEVETPCRNE | 1148 |
| 1021 | SLLTEVETPIRCEWGC | 1135 |
| 1022 | SLLTEVETCIRNC | 1134 |
| 1023 | SLLTEVETPIRCECG | 1121 |
| 1024 | CSLLTEVECPIRNE | 1116 |
| 1025 | SLLTEVECPCRNEWG | 1110 |
| 1026 | SCLTEVETPCRNEWG | 1083 |
| 1027 | CSLLTECETPIRNE | 1082 |
| 1028 | SLLTEVECPICNEWG | 1079 |
| 1029 | SLLTECETPIRCEWG | 1052 |
| 1030 | SLLTEVETCIRNEWC | 1049 |
| 1031 | SLCTEVETPIRNC | 1035 |
| 1032 | SLLTEVETCSLLTEVETPIRNEWGCR | 1032 |
| 1033 | SLLTECECPIRNEWG | 1031 |
| 1034 | SLLTEVETPICCEWG | 1029 |
| 1035 | SLLTEVECPIRCE | 1027 |
| 1036 | SLLTEVETPIRNCWG | 1021 |
| 1037 | SCLTEVCTPIRNE | 1019 |
| 1038 | SCLTEVETCIRNEWG | 1015 |
| 1039 | SLLTEVETPIRNCWC | 1002 |
| 1040 | SLLTEVETCSLLTEVETPIRC | 995 |
| 1041 | SLLTEVECPIRNEWG | 980 |
| 1042 | SLLTEVETSLLTEVETPIRNEWGCRC | 979 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 1043 | SLLTEVETSLLTEVETPIRNEWGCRCN | 970 |
| 1044 | SLLTEVCTCIRNE | 949 |
| 1045 | SLCTEVETPIRCE | 945 |
| 1046 | SLLTEVETCIRNECG | 941 |
| 1047 | SCLTEVETPIRNC | 940 |
| 1048 | SLLTEVETCSLLTEVETPIRNEWGC | 938 |
| 1049 | SLLTEVCTPIRNEWC | 937 |
| 1050 | SLLTEVECPIRNE | 927 |
| 1051 | SLLTEVETPICNEWGC | 923 |
| 1052 | SLLTEVETCSLLTEVETPIRNEWGSRSNDSSC | 916 |
| 1053 | SLLTEVETPIRCEWG | 902 |
| 1054 | SLCTEVETPIRNCWG | 899 |
| 1055 | SLLTEVETCIRCE | 898 |
| 1056 | SLLTECETPCRNEWG | 897 |
| 1057 | SLLTEVETPICNEWG | 890 |
| 1058 | SLLTEVETCSLLTEVETPIRNC | 890 |
| 1059 | SLLTECETPICNEWG | 885 |
| 1060 | SLLTECETPIRNEWG | 880 |
| 1061 | SLLTEVETPCRCEWG | 875 |
| 1062 | SLLTEVETCSLLTEVETPIRNEWGSRSNDC | 874 |
| 1063 | SLLTECCTPIRNEWG | 866 |
| 1064 | SLLTEVETCSLLTEVETPIRNEWGSRSNDSC | 861 |
| 1065 | SLLTEVCTPCRNE | 853 |
| 1066 | SCLTECETPIRNEWG | 847 |
| 1067 | SLLTEVETCSLLTEVETPC | 844 |
| 995 | SLLTEVETSLLTEVETPIRNEWGCRCNDS | 836 |
| 1068 | SLLTEVETCSLLTEVETPIRNEWGSRSNDSSDC | 831 |
| 1069 | SLLTEVETCSLLTEVETPIC | 830 |
| 1070 | SLLTEVETCSLLTEVETC | 820 |
| 1071 | SLLTEVETPCRNEWG | 813 |
| 1072 | CSLLTEVETPIRNEWGC | 798 |
| 1073 | SLLTEVCTPIRCE | 789 |
| 1074 | SLLTECETCIRNE | 785 |
| 1075 | SCLTECETPIRNE | 780 |
| 1076 | SLLTEVETCSLLTEVETPIRNEWC | 768 |
| 1077 | SLLTEVETPCCNEWG | 766 |
| 1078 | SLCTEVECPIRNEWG | 750 |
| 1079 | SLCTEVETPIRCEWG | 750 |
| 1080 | SLLTECETPIRNEWC | 741 |
| 1081 | SLLTEVCTPIRNEWGC | 739 |
| 1082 | SLLTEVETPIRCEWC | 732 |
| 1083 | SCLTEVETCIRNE | 727 |
| 1084 | SLLTEVETCICNE | 727 |
| 1085 | SLLTEVETPICNEWC | 724 |
| 1086 | SLLTEVECPIRNEWGC | 715 |
| 1087 | SLCTEVETCIRNE | 712 |
| 1088 | SLLTEVETCSLLTEVETPIRNEWGSC | 712 |
| 1089 | SLLTEVETSLLTEVETPIRNEWGCRCNDSS | 711 |
| 1090 | SCLTEVECPIRNE | 705 |
| 1091 | SLLTEVCTPICNE | 699 |
| 1092 | SLLTEVETPCRNEWGC | 696 |
| 1093 | SLLTEVETCIRNE | 675 |
| 1094 | SLLTEVCTPIRNECG | 674 |
| 1095 | SLLTEVETSLLTEVETPIRNEWGCRCNDSSD | 669 |
| 1096 | SLLTEVETPICNC | 665 |
| 1097 | SCLTEVETPIRNCWG | 662 |
| 1098 | SLLTEVETPICNECG | 660 |
| 1099 | SLLTEVECPIRNECG | 656 |
| 1100 | SLCTEVCTPIRNE | 653 |
| 1101 | SLLTECETPIRCE | 648 |
| 1102 | SLCTECETPIRNEWG | 648 |
| 1103 | SLCTEVECPIRNE | 645 |
| 1104 | SLLTECETPIRNC | 643 |
| 1105 | SLCTEVCTPIRNEWG | 641 |
| 1106 | SLLTEVETPIRNCCG | 638 |
| 1107 | SLLTEVETCSLLTEVETPIRNEC | 629 |
| 1108 | SLLTECETPIRNEWGC | 607 |
| 1109 | SLCTEVETPCRNEWG | 607 |
| 1110 | SLLTEVETPCRNEWC | 589 |
| 1111 | SLLTEVETPCRNECG | 587 |
| 1112 | SLLTEVECPICNE | 582 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 1113 | SLLTECETPIRNE | 578 |
| 1114 | SLCTEVETPICNEWG | 578 |
| 1115 | SLLTEVETPCRNC | 571 |
| 1116 | SLLTEVCTPIRNE | 568 |
| 1117 | SLLTEVETPIRNEWC | 558 |
| 1118 | SCLTEVECPIRNEWG | 542 |
| 1119 | SLLTEVECPCRNE | 538 |
| 1120 | SLCTEVETPCRNE | 535 |
| 1121 | SLCTEVETPIRNEWC | 535 |
| 1122 | SLLTECETPICNE | 531 |
| 1123 | SLLTECETPIRNECG | 528 |
| 1124 | SLCTEVETPIRNEWG | 510 |
| 1125 | SLLTECECPIRNE | 507 |
| 1126 | CMSLLTEVETPIRNC | 1864 |
| 1127 | MSLLTEVEKPIRNEWGCRCN | 1854 |
| 1128 | MSLLTEVETPCRNC | 1834 |
| 1129 | MSLLTEVECPIRNC | 1752 |
| 1130 | MSLLTEVCTPIRNC | 1738 |
| 1131 | DSLLTEVETPIRNEWGCRCN | 1713 |
| 1132 | MSLLTEVETPIRNEAGCRCN | 1700 |
| 1133 | MSLLTEVETPCRCE | 1651 |
| 1134 | MSLLTEVETPCRNE | 1638 |
| 1135 | MSLLTEVEMPIRNEWGCRCN | 1580 |
| 1136 | MSLLTEVEAPIRNEWGCRCN | 1544 |
| 1137 | MSLLTEVELPIRNEWGCRCN | 1521 |
| 1138 | MSLLTELETPIRNEWGCRCN | 1497 |
| 1139 | MSLLTEVETPIRNAWGCRCN | 1480 |
| 1140 | MSLTTEVETPIRNEWGCRCN | 1474 |
| 1141 | MTLLTEVETPIRNEWGCRCN | 1470 |
| 1142 | MSLLTEVETPICNC | 1451 |
| 1143 | MSLLTEVCTPIRCE | 1428 |
| 1144 | MSLLTEVETAIRNEWGCRCN | 1398 |
| 1145 | MSLCTEVETPIRNC | 1395 |
| 1146 | MSLLTEVETCIRNE | 1387 |
| 1147 | MSLLTEVETCICNE | 1378 |
| 1148 | MSLLTEVEEPIRNEWGCRCN | 1361 |
| 1149 | MSLLTEVETPIRNEWGCRCN | 1360 |
| 1150 | MSLLTEVEQPIRNEWGCRCN | 1345 |
| 1151 | MSLLTEVECPIRCE | 1336 |
| 1152 | MSLLTEKETPIRNEWGCRCN | 1324 |
| 1153 | ESLLTEVETPIRNEWGCRCN | 1310 |
| 1154 | MSLCTEVETCIRNE | 1305 |
| 1155 | MSLLTETETPIRNEWGCRCN | 1279 |
| 1156 | MSLLTEIETPIRNEWGCRCN | 1255 |
| 1157 | MSLLTEVETPIRNEWGCRAN | 1252 |
| 1158 | MSLLTEVCTPCRNE | 1244 |
| 1159 | TSLLTEVETPIRNEWGCRCN | 1243 |
| 1160 | MSLCTEVCTPIRNE | 1243 |
| 1161 | MSLLTEVETPIRNEWGCRCA | 1233 |
| 1162 | MSLVTEVETPIRNEWGCRCN | 1202 |
| 1163 | MSCLTEVETPIRCE | 1192 |
| 1164 | MSLATEVETPIRNEWGCRCN | 1188 |
| 1165 | MSLLTEVVTPIRNEWGCRCN | 1183 |
| 1166 | MSLLTEVQTPIRNEWGCRCN | 1172 |
| 1167 | MSLITEVETPIRNEWGCRCN | 1167 |
| 1168 | MSLLTEVECPIRNE | 1158 |
| 1169 | MSLLTEVCTPICNE | 1157 |
| 1170 | MSLLTEPETPIRNEWGCRCN | 1153 |
| 1171 | MSLLTEVEFPIRNEWGCRCN | 1149 |
| 1172 | MSLLTEVETPARNEWGCRCN | 1149 |
| 1173 | MSLLTEVETPIRNEWGARCN | 1149 |
| 1174 | MSLLTEVMTPIRNEWGCRCN | 1133 |
| 1175 | MSLLTECETPIRCE | 1131 |
| 1176 | CMSLLTEVECPIRNE | 1122 |
| 1177 | ASLLTEVETPIRNEWGCRCN | 1111 |
| 1178 | MSLLTEVETCIRCE | 1105 |
| 1179 | MSCLTEVETPIRNC | 1102 |
| 1180 | MSLLTEVEGPIRNEWGCRCN | 1099 |
| 1181 | MSLLTEVETPIRNEWACRCN | 1087 |
| 1182 | MSLLTEMETPIRNEWGCRCN | 1075 |
| 1183 | KSLLTEVETPIRNEWGCRCN | 1068 |

TABLE 2-continued

Peptides that specifically bind for 23K21 and 8I10 (A numeral "1" in the peptide sequence indicates a differentially protected cystein allowing for selective CLIP attachment at certain residues)

| SEQ ID NO: | Peptides that bind to 23K21 and 8I10 | Signal |
|---|---|---|
| 1184 | MSLLTEVEVPIRNEWGCRCN | 1064 |
| 1185 | MSLCTEVETPCRNE | 1064 |
| 1186 | MSCLTEVCTPIRNE | 1055 |
| 1187 | CMSLLTEVCTPIRNE | 1054 |
| 1188 | VSLLTEVETPIRNEWGCRCN | 1054 |
| 1189 | MSLLTEVESPIRNEWGCRCN | 1051 |
| 1190 | MSLLTEVSTPIRNEWGCRCN | 1045 |
| 1191 | MSLLTEFETPIRNEWGCRCN | 1044 |
| 1192 | CMSLLTEVETPIRCE | 1034 |
| 1193 | MSLCTEVECPIRNE | 1023 |
| 1194 | MSLLTECETPICNE | 1016 |
| 1195 | MSLLTEVTTPIRNEWGCRCN | 1013 |
| 1196 | RSLLTEVETPIRNEWGCRCN | 1012 |
| 1197 | MSLLTEVEDPIRNEWGCRCN | 1004 |
| 1198 | MSLLTEAETPIRNEWGCRCN | 1003 |
| 1199 | CMSLLTEVETPCRNE | 992 |
| 1200 | MSLLTEVETPIRAEWGCRCN | 978 |
| 1201 | MSLLTEVCTCIRNE | 959 |
| 1202 | MSLLTECECPIRNE | 958 |
| 1203 | HSLLTEVETPIRNEWGCRCN | 956 |
| 1204 | CMSLLTECETPIRNE | 937 |
| 1205 | MSLLTEVENPIRNEWGCRCN | 936 |
| 1206 | MSLLTECETPCRNE | 932 |
| 1207 | MSLLTEVERPIRNEWGCRCN | 926 |
| 1208 | MSLLTEQETPIRNEWGCRCN | 913 |
| 1209 | MSLLTEVETCIRNC | 908 |
| 1210 | MSFLTEVETPIRNEWGCRCN | 907 |
| 1211 | CMSLLTEVETCIRNE | 896 |
| 1212 | PSLLTEVETPIRNEWGCRCN | 841 |
| 1213 | MSLETEVETPIRNEWGCRCN | 838 |
| 1214 | MSLLTEVEHPIRNEWGCRCN | 838 |
| 1215 | YSLLTEVETPIRNEWGCRCN | 835 |
| 1216 | MSLLTEVCTPIRNE | 824 |
| 1217 | MSLLTEVECPICNE | 821 |
| 1218 | MSLLTEVETPIANEWGCRCN | 814 |
| 1219 | LSLLTEVETPIRNEWGCRCN | 801 |
| 1220 | WSLLTEVETPIRNEWGCRCN | 742 |
| 1221 | MSLLTEVETPIRNEWGCACN | 739 |
| 1222 | MSLLTEVECPCRNE | 736 |
| 1223 | MSCLTEVECPIRNE | 730 |
| 1224 | FSLLTEVETPIRNEWGCRCN | 707 |
| 1225 | NSLLTEVETPIRNEWGCRCN | 706 |
| 1226 | MSLLTEVEYPIRNEWGCRCN | 685 |
| 1227 | MSLLTDVETPIRNEWGCRCN | 679 |
| 1228 | MSKLTEVETPIRNEWGCRCN | 672 |
| 1229 | MSCLTEVETCIRNE | 649 |
| 1230 | MSLSTEVETPIRNEWGCRCN | 648 |
| 1231 | MSLLTECETPIRNE | 630 |
| 1232 | ISLLTEVETPIRNEWGCRCN | 629 |
| 1233 | MSCLTEVETPCRNE | 625 |
| 1234 | MSLCTEVETPIRNE | 618 |
| 1235 | CMSLLTEVETPICNE | 615 |
| 1236 | MSLLTEVEPPIRNEWGCRCN | 610 |
| 1237 | MSCLTEVETPIRNE | 602 |
| 1238 | GSLLTEVETPIRNEWGCRCN | 584 |
| 1239 | MSLCTEVETPIRCE | 568 |
| 1240 | MSLKTEVETPIRNEWGCRCN | 567 |
| 1241 | MSLLTEEETPIRNEWGCRCN | 545 |
| 1242 | CSLCTEVETPIRNE | 518 |
| 1243 | QSLLTEVETPIRNEWGCRCN | 440 |
| 1244 | MSLLTEVEIPIRNEWGCRCN | 409 |
| 1245 | MSLLTESETPIRNEWGCRCN | 369 |
| 1246 | MSLLTEGETPIRNEWGCRCN | 357 |
| 1247 | MSLLTECETPIRNC | 344 |
| 1248 | MSLLTECETCIRNE | 312 |
| 1249 | SSLLTEVETPIRNEWGCRCN | 303 |

TABLE 3

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
| --- | --- | --- |
| 1177 | ASLLTEVETPIRNEWGCRCN | 2816 |
| 1131 | DSLLTEVETPIRNEWGCRCN | 2814 |
| 1153 | ESLLTEVETPIRNEWGCRCN | 2816 |
| 1224 | FSLLTEVETPIRNEWGCRCN | 2665 |
| 1238 | GSLLTEVETPIRNEWGCRCN | 2635 |
| 1203 | HSLLTEVETPIRNEWGCRCN | 2490 |
| 1232 | ISLLTEVETPIRNEWGCRCN | 2438 |
| 1183 | KSLLTEVETPIRNEWGCRCN | 2618 |
| 1219 | LSLLTEVETPIRNEWGCRCN | 2506 |
| 1149 | MSLLTEVETPIRNEWGCRCN | 2711 |
| 1225 | NSLLTEVETPIRNEWGCRCN | 2485 |
| 1212 | PSLLTEVETPIRNEWGCRCN | 2694 |
| 1243 | QSLLTEVETPIRNEWGCRCN | 2619 |
| 1196 | RSLLTEVETPIRNEWGCRCN | 2550 |
| 1249 | SSLLTEVETPIRNEWGCRCN | 2404 |
| 1159 | TSLLTEVETPIRNEWGCRCN | 2834 |
| 1188 | VSLLTEVETPIRNEWGCRCN | 2816 |
| 1220 | WSLLTEVETPIRNEWGCRCN | 2693 |
| 1215 | YSLLTEVETPIRNEWGCRCN | 2650 |
| 1250 | MALLTEVETPIRNEWGCRCN | 2604 |
| 1251 | MDLLTEVETPIRNEWGCRCN | 2726 |
| 1252 | MELLTEVETPIRNEWGCRCN | 2679 |
| 1253 | MFLLTEVETPIRNEWGCRCN | 1707 |
| 1254 | MGLLTEVETPIRNEWGCRCN | 2635 |
| 1255 | MHLLTEVETPIRNEWGCRCN | 2449 |
| 1256 | MILLTEVETPIRNEWGCRCN | 1634 |
| 1257 | MKLLTEVETPIRNEWGCRCN | 2629 |
| 1258 | MLLLTEVETPIRNEWGCRCN | 2091 |
| 1259 | MMLLTEVETPIRNEWGCRCN | 2666 |
| 1260 | MNLLTEVETPIRNEWGCRCN | 2733 |
| 1261 | MPLLTEVETPIRNEWGCRCN | 2521 |
| 1262 | MQLLTEVETPIRNEWGCRCN | 2526 |
| 1263 | MRLLTEVETPIRNEWGCRCN | 2519 |
| 1141 | MTLLTEVETPIRNEWGCRCN | 2809 |
| 1264 | MVLLTEVETPIRNEWGCRCN | 2465 |
| 1265 | MWLLTEVETPIRNEWGCRCN | 2615 |
| 1266 | MYLLTEVETPIRNEWGCRCN | 1960 |
| 1210 | MSFLTEVETPIRNEWGCRCN | 1087 |
| 1267 | MSILTEVETPIRNEWGCRCN | 2582 |
| 1268 | MSMLTEVETPIRNEWGCRCN | 1329 |
| 1269 | MSVLTEVETPIRNEWGCRCN | 2111 |
| 1164 | MSLATEVETPIRNEWGCRCN | 2747 |
| 1270 | MSLDTEVETPIRNEWGCRCN | 2594 |
| 1213 | MSLETEVETPIRNEWGCRCN | 2768 |
| 1271 | MSLFTEVETPIRNEWGCRCN | 2115 |
| 1272 | MSLHTEVETPIRNEWGCRCN | 2058 |
| 1167 | MSLITEVETPIRNEWGCRCN | 2684 |
| 1240 | MSLKTEVETPIRNEWGCRCN | 2691 |
| 1273 | MSLMTEVETPIRNEWGCRCN | 2804 |
| 1274 | MSLNTEVETPIRNEWGCRCN | 2787 |
| 1275 | MSLPTEVETPIRNEWGCRCN | 2007 |
| 1276 | MSLQTEVETPIRNEWGCRCN | 2792 |
| 1277 | MSLRTEVETPIRNEWGCRCN | 2554 |
| 1230 | MSLSTEVETPIRNEWGCRCN | 2768 |
| 1140 | MSLTTEVETPIRNEWGCRCN | 2742 |
| 1162 | MSLVTEVETPIRNEWGCRCN | 2776 |
| 1278 | MSLYTEVETPIRNEWGCRCN | 1313 |
| 1279 | MSLLAEVETPIRNEWGCRCN | 2807 |
| 1280 | MSLLDEVETPIRNEWGCRCN | 2763 |
| 1281 | MSLLEEVETPIRNEWGCRCN | 2805 |
| 1282 | MSLLFEVETPIRNEWGCRCN | 2581 |
| 1283 | MSLLGEVETPIRNEWGCRCN | 2717 |
| 1284 | MSLLHEVETPIRNEWGCRCN | 2691 |
| 1285 | MSLLIEVETPIRNEWGCRCN | 2371 |
| 1286 | MSLLKEVETPIRNEWGCRCN | 2825 |
| 1287 | MSLLLEVETPIRNEWGCRCN | 2804 |
| 1288 | MSLLMEVETPIRNEWGCRCN | 2847 |
| 1289 | MSLLNEVETPIRNEWGCRCN | 2824 |
| 1290 | MSLLPEVETPIRNEWGCRCN | 2728 |
| 1291 | MSLLQEVETPIRNEWGCRCN | 2792 |
| 1292 | MSLLREVETPIRNEWGCRCN | 2699 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 1293 | MSLLSEVETPIRNEWGCRCN | 2790 |
| 1294 | MSLLVEVETPIRNEWGCRCN | 2732 |
| 1295 | MSLLWEVETPIRNEWGCRCN | 2531 |
| 1296 | MSLLYEVETPIRNEWGCRCN | 2464 |
| 1227 | MSLLTDVETPIRNEWGCRCN | 2476 |
| 1297 | MSLLTQVETPIRNEWGCRCN | 1697 |
| 1298 | MSLLTTVETPIRNEWGCRCN | 2699 |
| 1156 | MSLLTEIETPIRNEWGCRCN | 2799 |
| 1138 | MSLLTELETPIRNEWGCRCN | 2589 |
| 1155 | MSLLTETETPIRNEWGCRCN | 2641 |
| 1299 | MSLLTEVATPIRNEWGCRCN | 2633 |
| 1300 | MSLLTEVDTPIRNEWGCRCN | 2856 |
| 1301 | MSLLTEVFTPIRNEWGCRCN | 1858 |
| 1302 | MSLLTEVGTPIRNEWGCRCN | 2789 |
| 1303 | MSLLTEVHTPIRNEWGCRCN | 2751 |
| 1304 | MSLLTEVITPIRNEWGCRCN | 2668 |
| 1305 | MSLLTEVKTPIRNEWGCRCN | 2708 |
| 1306 | MSLLTEVLTPIRNEWGCRCN | 2714 |
| 1174 | MSLLTEVMTPIRNEWGCRCN | 2813 |
| 1307 | MSLLTEVNTPIRNEWGCRCN | 2807 |
| 1308 | MSLLTEVPTPIRNEWGCRCN | 2380 |
| 1166 | MSLLTEVQTPIRNEWGCRCN | 2813 |
| 1309 | MSLLTEVRTPIRNEWGCRCN | 2668 |
| 1190 | MSLLTEVSTPIRNEWGCRCN | 2783 |
| 1195 | MSLLTEVTTPIRNEWGCRCN | 2791 |
| 1165 | MSLLTEVVTPIRNEWGCRCN | 2732 |
| 1310 | MSLLTEVWTPIRNEWGCRCN | 2546 |
| 1311 | MSLLTEVYTPIRNEWGCRCN | 2181 |
| 1136 | MSLLTEVEAPIRNEWGCRCN | 2833 |
| 1197 | MSLLTEVEDPIRNEWGCRCN | 2826 |
| 1148 | MSLLTEVEEPIRNEWGCRCN | 2835 |
| 1171 | MSLLTEVFPIRNEWGCRCN | 2728 |
| 1180 | MSLLTEVEGPIRNEWGCRCN | 2802 |
| 1214 | MSLLTEVEHPIRNEWGCRCN | 2753 |
| 1244 | MSLLTEVEIPIRNEWGCRCN | 2742 |
| 1127 | MSLLTEVEKPIRNEWGCRCN | 2837 |
| 1137 | MSLLTEVELPIRNEWGCRCN | 2797 |
| 1135 | MSLLTEVEMPIRNEWGCRCN | 2839 |
| 1205 | MSLLTEVENPIRNEWGCRCN | 2805 |
| 1236 | MSLLTEVEPPIRNEWGCRCN | 2797 |
| 1150 | MSLLTEVEQPIRNEWGCRCN | 2826 |
| 1207 | MSLLTEVERPIRNEWGCRCN | 2753 |
| 1189 | MSLLTEVESPIRNEWGCRCN | 2712 |
| 1184 | MSLLTEVEVPIRNEWGCRCN | 2768 |
| 1312 | MSLLTEVEWPIRNEWGCRCN | 2541 |
| 1226 | MSLLTEVEYPIRNEWGCRCN | 2571 |
| 1144 | MSLLTEVETAIRNEWGCRCN | 2722 |
| 1172 | MSLLTEVETPARNEWGCRCN | 2774 |
| 1218 | MSLLTEVETPIANEWGCRCN | 2683 |
| 1200 | MSLLTEVETPIRAEWGCRCN | 2742 |
| 1139 | MSLLTEVETPIRNAWGCRCN | 2803 |
| 1132 | MSLLTEVETPIRNEAGCRCN | 2831 |
| 1181 | MSLLTEVETPIRNEWACRCN | 2732 |
| 1173 | MSLLTEVETPIRNEWGARCN | 2760 |
| 1221 | MSLLTEVETPIRNEWGCACN | 2662 |
| 1157 | MSLLTEVETPIRNEWGCRAN | 2769 |
| 1161 | MSLLTEVETPIRNEWGCRCA | 2770 |
| 1126 | CMSLLTEVETPIRNC | 2767 |
| 1192 | CMSLLTEVETPIRCE | 2453 |
| 1235 | CMSLLTEVETPICNE | 2331 |
| 1199 | CMSLLTEVETPCRNE | 2789 |
| 1211 | CMSLLTEVETCIRNE | 2713 |
| 1176 | CMSLLTEVECPIRNE | 2730 |
| 1187 | CMSLLTEVCTPIRNE | 2633 |
| 1313 | CMSLLCEVETPIRNE | 2582 |
| 1314 | CMSLCTEVETPIRNE | 1705 |
| 1315 | CMCLLTEVETPIRNE | 2347 |
| 984 | CSLLTEVETPIRNC | 2782 |
| 997 | CSLLTEVETPIRCE | 2516 |
| 1012 | CSLLTEVETPICNE | 2444 |
| 1020 | CSLLTEVETPCRNE | 2470 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 1013 | CSLLTEVETCIRNE | 2301 |
| 1024 | CSLLTEVECPIRNE | 2226 |
| 990 | CSLLTEVCTPIRNE | 1942 |
| 1316 | CSLLCEVETPIRNE | 2527 |
| 1242 | CSLCTEVETPIRNE | 1832 |
| 1317 | MCLLTEVETPIRNC | 2743 |
| 1318 | MCLLTEVETPIRCE | 2307 |
| 1319 | MCLLTEVETPICNE | 2379 |
| 1320 | MCLLTEVETPCRNE | 2404 |
| 1321 | MCLLTEVETCIRNE | 1948 |
| 1322 | MCLLTEVECPIRNE | 2421 |
| 1323 | MCLLTEVCTPIRNE | 1407 |
| 1324 | MCLLCEVETPIRNE | 2038 |
| 1145 | MSLCTEVETPIRNC | 2601 |
| 1239 | MSLCTEVETPIRCE | 1555 |
| 1185 | MSLCTEVETPCRNE | 1673 |
| 1193 | MSLCTEVECPIRNE | 1538 |
| 1160 | MSLCTEVCTPIRNE | 1906 |
| 1325 | MSLLCEVETPIRNC | 2823 |
| 1326 | MSLLCEVETPIRCE | 2772 |
| 1327 | MSLLCEVETPICNE | 2704 |
| 1328 | MSLLCEVETPCRNE | 2652 |
| 1329 | MSLLCEVETCIRNE | 2589 |
| 1330 | MSLLCEVECPIRNE | 2606 |
| 1331 | MSLLCEVCTPIRNE | 2601 |
| 1130 | MSLLTEVCTPIRNC | 2787 |
| 1143 | MSLLTEVCTPIRCE | 2667 |
| 1169 | MSLLTEVCTPICNE | 2526 |
| 1158 | MSLLTEVCTPCRNE | 2572 |
| 1201 | MSLLTEVCTCIRNE | 2143 |
| 1168 | MSLLTEVECPIRNE | 2613 |
| 1129 | MSLLTEVECPIRNC | 2755 |
| 1151 | MSLLTEVECPIRCE | 2675 |
| 1217 | MSLLTEVECPICNE | 2440 |
| 1222 | MSLLTEVECPCRNE | 2361 |
| 1146 | MSLLTEVETCIRNE | 2129 |
| 1209 | MSLLTEVETCIRNC | 2309 |
| 1178 | MSLLTEVETCIRCE | 2739 |
| 1147 | MSLLTEVETCICNE | 2721 |
| 1134 | MSLLTEVETPCRNE | 2695 |
| 1128 | MSLLTEVETPCRNC | 2810 |
| 1133 | MSLLTEVETPCRCE | 2597 |
| 1142 | MSLLTEVETPICNC | 2758 |
| 1018 | CSLLTEVETPIRNE | 2211 |
| 1332 | MCLLTEVETPIRNE | 2364 |
| 1234 | MSLCTEVETPIRNE | 2054 |
| 1333 | MSLLCEVETPIRNE | 2454 |
| 1216 | MSLLTEVCTPIRNE | 2529 |
| 287 | MSLLTEVGMSLLTEV | 2878 |
| 293 | CSLLTEVGMSLLTEV | 2827 |
| 513 | MCLLTEVGMSLLTEV | 2697 |
| 532 | MSCLTEVGMSLLTEV | 2336 |
| 371 | MSLCTEVGMSLLTEV | 2691 |
| 749 | MSLLCEVGMSLLTEV | 2786 |
| 543 | MSLLTCVGMSLLTEV | 2627 |
| 339 | MSLLTECGMSLLTEV | 2170 |
| 288 | CSCLCEVGMSLLTEV | 1812 |
| 663 | MCLCTCVGMSLLTEV | 2509 |
| 294 | MSCLCECGMSLLTEV | 1006 |
| 373 | CSLLTECGMSLLTEV | 1235 |
| 316 | MSLLTEVGCSLLTEV | 2650 |
| 364 | CSLLTEVGCSLLTEV | 2503 |
| 570 | MCLLTEVGCSLLTEV | 2717 |
| 557 | MSCLTEVGCSLLTEV | 2506 |
| 508 | MSLCTEVGCSLLTEV | 2832 |
| 781 | MSLLCEVGCSLLTEV | 2761 |
| 528 | MSLLTCVGCSLLTEV | 2467 |
| 363 | MSLLTECGCSLLTEV | 1235 |
| 536 | MCLCTCVGCSLLTEV | 2241 |
| 360 | CSLLTECGCSLLTEV | 1427 |
| 296 | MSLLTEVGMCLLTEV | 2809 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 303 | CSLLTEVGMCLLTEV | 2618 |
| 1334 | MSLLCEVGMCLLTEV | 2676 |
| 359 | MSLLTEVGMSCLTEV | 2793 |
| 372 | CSLLTEVGMSCLTEV | 2554 |
| 1335 | MCLLTEVGMSCLTEV | 1869 |
| 1336 | MSLLCEVGMSCLTEV | 2846 |
| 317 | MSLLTEVGMSLCTEV | 2895 |
| 334 | CSLLTEVGMSLCTEV | 2857 |
| 1337 | MCLLTEVGMSLCTEV | 2513 |
| 289 | MSLCTEVGMSLCTEV | 1093 |
| 1338 | MSLLCEVGMSLCTEV | 2595 |
| 793 | MSLLTEVGMSLLCEV | 2819 |
| 309 | CSLLTEVGMSLLCEV | 2734 |
| 1339 | MCLLTEVGMSLLCEV | 2234 |
| 1340 | MSCLTEVGMSLLCEV | 2341 |
| 304 | MSLCTEVGMSLLCEV | 2616 |
| 1341 | MSLLCEVGMSLLCEV | 2851 |
| 1342 | MSLLTCVGMSLLCEV | 2712 |
| 460 | MSLLTECGMSLLCEV | 2373 |
| 1343 | CSCLCEVGMSLLCEV | 1945 |
| 1344 | MCLCTCVGMSLLCEV | 2431 |
| 1345 | MSCLCECGMSLLCEV | 1307 |
| 456 | CSLLTECGMSLLCEV | 1640 |
| 285 | MSLLTEVGMSLLTCV | 2872 |
| 286 | CSLLTEVGMSLLTCV | 2768 |
| 1346 | MCLLTEVGMSLLTCV | 1098 |
| 542 | MSLCTEVGMSLLTCV | 2722 |
| 1347 | MSLLCEVGMSLLTCV | 2784 |
| 343 | MSLLTEVGMSLLTEC | 2831 |
| 451 | CSLLTEVGMSLLTEC | 2613 |
| 825 | MSLLCEVGMSLLTEC | 2617 |
| 761 | MSLLTEVGCSCLCEV | 2053 |
| 476 | CSLLTEVGCSCLCEV | 1680 |
| 1348 | MSLCTEVGCSCLCEV | 2001 |
| 1349 | MSLLCEVGCSCLCEV | 2586 |
| 291 | MSLLTEVGMCLCTCV | 2842 |
| 297 | CSLLTEVGMCLCTCV | 2649 |
| 1350 | MSLLCEVGMCLCTCV | 2664 |
| 829 | MSLLTEVGMSCLCEC | 2444 |
| 499 | CSLLTEVGMSCLCEC | 2101 |
| 1351 | MSLLCEVGMSCLCEC | 2492 |
| 470 | MSLLTEVGCSLLTEC | 2349 |
| 383 | CSLLTEVGCSLLTEC | 2486 |
| 592 | MSLCTEVGCSLLTEC | 1971 |
| 826 | MSLLCEVGCSLLTEC | 2573 |
| 365 | CSLLTEVCMSLLTEC | 1891 |
| 1352 | CCLLTEVETPIRNE | 2155 |
| 1353 | CLLTEVETPIRNC | 1996 |
| 1354 | CLLTEVETPIRCE | 1813 |
| 1355 | CLLTEVETPICNE | 1647 |
| 1356 | CLLTEVETPCRNE | 1991 |
| 1357 | CLLTEVETCIRNE | 1661 |
| 1358 | CLLTEVECPIRNE | 2326 |
| 1359 | CLLTEVCTPIRNE | 1585 |
| 1360 | CLLCEVETPIRNE | 2314 |
| 1100 | SLCTEVCTPIRNE | 1674 |
| 1361 | SLLCEVETPIRNC | 2460 |
| 1362 | SLLCEVETPIRCE | 2307 |
| 1363 | SLLCEVETPICNE | 1921 |
| 1364 | SLLCEVETPCRNE | 2035 |
| 1365 | SLLCEVETCIRNE | 2305 |
| 1366 | SLLCEVECPIRNE | 2377 |
| 1367 | SLLCEVCTPIRNE | 2283 |
| 1016 | SLLTEVCTPIRNC | 2308 |
| 1073 | SLLTEVCTPIRCE | 1873 |
| 1091 | SLLTEVCTPICNE | 1659 |
| 1065 | SLLTEVCTPCRNE | 2016 |
| 1044 | SLLTEVCTCIRNE | 1695 |
| 1050 | SLLTEVCPIRNE | 2469 |
| 1007 | SLLTEVECPIRNC | 2635 |
| 1035 | SLLTEVECPIRCE | 2426 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 1112 | SLLTEVECPICNE | 2022 |
| 1119 | SLLTEVECPCRNE | 1840 |
| 1093 | SLLTEVETCIRNE | 1792 |
| 1022 | SLLTEVETCIRNC | 2289 |
| 1055 | SLLTEVETCIRCE | 2161 |
| 1084 | SLLTEVETCICNE | 1953 |
| 1368 | SLLTEVETPCRNE | 1665 |
| 1115 | SLLTEVETPCRNC | 1816 |
| 1369 | SLLTEVETPCRCE | 1546 |
| 1096 | SLLTEVETPICNC | 2075 |
| 1370 | CLLTEVETPIRNE | 1524 |
| 1371 | SLLCEVETPIRNE | 2511 |
| 1116 | SLLTEVCTPIRNE | 1854 |
| 1072 | CSLLTEVETPIRNEWGC | 2232 |
| 1372 | CLLTEVETPIRNEWGC | 1866 |
| 1373 | SLLCEVETPIRNEWGC | 2281 |
| 1081 | SLLTEVCTPIRNEWGC | 1866 |
| 1086 | SLLTEVECPIRNEWGC | 2142 |
| 991 | SLLTEVETCIRNEWGC | 2284 |
| 1092 | SLLTEVETPCRNEWGC | 1873 |
| 1051 | SLLTEVETPICNEWGC | 2101 |
| 1021 | SLLTEVETPIRCEWGC | 2435 |
| 1015 | SLLTEVETPIRNCWGC | 2513 |
| 1374 | SLLTEVETPIRNECGC | 1660 |
| 1375 | SLLTEVETPIRNEWCC | 1813 |
| 1376 | CLLTEVETPIRNEWC | 1743 |
| 1377 | CLLTEVETPIRNECG | 1501 |
| 1378 | CLLTEVETPIRNCWG | 2388 |
| 1379 | CLLTEVETPIRCEWG | 2169 |
| 1380 | CLLTEVETPICNEWG | 2120 |
| 1381 | CLLTEVETPCRNEWG | 2074 |
| 1382 | CLLTEVETCIRNEWG | 2296 |
| 1383 | CLLTEVECPIRNEWG | 2157 |
| 1384 | CLLCEVETPIRNEWG | 2388 |
| 1385 | CLLTEVETPIRNEWG | 2142 |
| 1105 | SLCTEVCTPIRNEWG | 1477 |
| 1386 | SLCCEVETPIRNEWG | 1603 |
| 1387 | SLLCEVETPIRNEWC | 2406 |
| 1388 | SLLCEVETPIRNECG | 2107 |
| 1389 | SLLCEVETPIRNCWG | 2789 |
| 1390 | SLLCEVETPIRCEWG | 2601 |
| 1391 | SLLCEVETPICNEWG | 2536 |
| 1392 | SLLCEVETPCRNEWG | 2465 |
| 1393 | SLLCEVETCIRNEWG | 2531 |
| 1394 | SLLCEVECPIRNEWG | 2529 |
| 1395 | SLLCEVCTPIRNEWG | 2384 |
| 1396 | SLLCEVETPIRNEWG | 2384 |
| 1049 | SLLTEVCTPIRNEWC | 1883 |
| 1094 | SLLTEVCTPIRNECG | 1782 |
| 1000 | SLLTEVCTPIRNCWG | 2420 |
| 988 | SLLTEVCTPIRCEWG | 2090 |
| 987 | SLLTEVCTPICNEWG | 1883 |
| 996 | SLLTEVCTPCRNEWG | 1841 |
| 985 | SLLTEVCTCIRNEWG | 1546 |
| 1014 | SLLTEVCCPIRNEWG | 2253 |
| 1019 | SLLTEVCTPIRNEWG | 2692 |
| 1397 | CLLTEVCTPIRNEWG | 1634 |
| 1017 | SLLTEVECPIRNEWC | 2141 |
| 1099 | SLLTEVECPIRNECG | 2001 |
| 1001 | SLLTEVECPIRNCWG | 2589 |
| 989 | SLLTEVECPIRCEWG | 2509 |
| 1028 | SLLTEVECPICNEWG | 2449 |
| 1025 | SLLTEVECPCRNEWG | 2303 |
| 1004 | SLLTEVECCIRNEWG | 2507 |
| 1041 | SLLTEVECPIRNEWG | 2267 |
| 1030 | SLLTEVETCIRNEWC | 2337 |
| 1046 | SLLTEVETCIRNECG | 2018 |
| 992 | SLLTEVETCIRNCWG | 2616 |
| 998 | SLLTEVETCIRCEWG | 2566 |
| 1006 | SLLTEVETCICNEWG | 2498 |
| 993 | SLLTEVETCCRNEWG | 2389 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 1009 | SLLTEVETCIRNEWG | 2462 |
| 1110 | SLLTEVETPCRNEWC | 1867 |
| 1111 | SLLTEVETPCRNECG | 1470 |
| 1005 | SLLTEVETPCRNCWG | 2602 |
| 1061 | SLLTEVETPCRCEWG | 2155 |
| 1077 | SLLTEVETPCCNEWG | 2208 |
| 1071 | SLLTEVETPCRNEWG | 2167 |
| 1085 | SLLTEVETPICNEWC | 2488 |
| 1098 | SLLTEVETPICNECG | 2041 |
| 1010 | SLLTEVETPICNCWG | 2624 |
| 1034 | SLLTEVETPICCEWG | 2525 |
| 1057 | SLLTEVETPICNEWG | 2395 |
| 1082 | SLLTEVETPIRCEWC | 2255 |
| 1023 | SLLTEVETPIRCECG | 2464 |
| 994 | SLLTEVETPIRCCWG | 2755 |
| 1053 | SLLTEVETPIRCEWG | 2365 |
| 1039 | SLLTEVETPIRNCWC | 2321 |
| 1106 | SLLTEVETPIRNCCG | 1923 |
| 1036 | SLLTEVETPIRNCWG | 2350 |
| 1398 | SLLTEVETPIRNECC | 1493 |
| 1399 | SLLTEVETPIRNECG | 1545 |
| 1117 | SLLTEVETPIRNEWC | 1856 |
| 1070 | SLLTEVETCSLLTEVETC | 2104 |
| 1067 | SLLTEVETCSLLTEVETPC | 2082 |
| 1069 | SLLTEVETCSLLTEVETPIC | 2169 |
| 1040 | SLLTEVETCSLLTEVETPIRC | 2402 |
| 1058 | SLLTEVETCSLLTEVETPIRNC | 2295 |
| 1107 | SLLTEVETCSLLTEVETPIRNEC | 2025 |
| 1076 | SLLTEVETCSLLTEVETPIRNEWC | 2169 |
| 1048 | SLLTEVETCSLLTEVETPIRNEWGC | 2010 |
| 1088 | SLLTEVETCSLLTEVETPIRNEWGSC | 2180 |
| 986 | SLLTEVETCSLLTEVETPIRNEWGSRC | 2757 |
| 999 | SLLTEVETCSLLTEVETPIRNEWGSRSC | 2792 |
| 1011 | SLLTEVETCSLLTEVETPIRNEWGSRSNC | 2673 |
| 1062 | SLLTEVETCSLLTEVETPIRNEWGSRSNDC | 2483 |
| 1064 | SLLTEVETCSLLTEVETPIRNEWGSRSNDSC | 2335 |
| 1052 | SLLTEVETCSLLTEVETPIRNEWGSRSNDSSC | 2404 |
| 1068 | SLLTEVETCSLLTEVETPIRNEWGSRSNDSSDC | 2294 |
| 1032 | SLLTEVETCSLLTEVETPIRNEWGCR | 2395 |
| 1042 | SLLTEVETSLLTEVETPIRNEWGCRC | 2324 |
| 1043 | SLLTEVETSLLTEVETPIRNEWGCRCN | 2390 |
| 995 | SLLTEVETSLLTEVETPIRNEWGCRCND | 2393 |
| 995 | SLLTEVETSLLTEVETPIRNEWGCRCNDS | 2260 |
| 1089 | SLLTEVETSLLTEVETPIRNEWGCRCNDSS | 2212 |
| 1095 | SLLTEVETSLLTEVETPIRNEWGCRCNDSSD | 1980 |
| 831 | 1CSLLTEVETP1SLLTEVETPCSLLTEVETP1 | 2714 |
| 867 | 1CLLTEVETPI1SLLTEVETPCSLLTEVETP1 | 2593 |
| 836 | 1CLTEVETPIR1SLLTEVETPCSLLTEVETP1 | 2645 |
| 839 | 1CTEVETPIRN1SLLTEVETPCSLLTEVETP1 | 2420 |
| 848 | 1CEVETPIRNE1SLLTEVETPCSLLTEVETP1 | 2460 |
| 860 | 1CVETPIRNEW1SLLTEVETPCSLLTEVETP1 | 2474 |
| 858 | 1CETPIRNEWG1SLLTEVETPCSLLTEVETP1 | 2566 |
| 900 | 1CSLLTEVETP1LLTEVETPICSLLTEVETP1 | 2437 |
| 1400 | 1CLLTEVETPI1LLTEVETPICSLLTEVETP1 | 2220 |
| 1401 | 1CLTEVETPIR1LLTEVETPICSLLTEVETP1 | 2316 |
| 1402 | 1CTEVETPIRN1LLTEVETPICSLLTEVETP1 | 2258 |
| 1403 | 1CEVETPIRNE1LLTEVETPICSLLTEVETP1 | 2133 |
| 977 | 1CVETPIRNEW1LLTEVETPICSLLTEVETP1 | 1946 |
| 1404 | 1CETPIRNEWG1LLTEVETPICSLLTEVETP1 | 2288 |
| 841 | 1CSLLTEVETP1LTEVETPIRCSLLTEVETP1 | 2521 |
| 849 | 1CLLTEVETPI1LTEVETPIRCSLLTEVETP1 | 2601 |
| 863 | 1CLTEVETPIR1LTEVETPIRCSLLTEVETP1 | 2476 |
| 854 | 1CTEVETPIRN1LTEVETPIRCSLLTEVETP1 | 2469 |
| 872 | 1CEVETPIRNE1LTEVETPIRCSLLTEVETP1 | 2304 |
| 876 | 1CVETPIRNEW1LTEVETPIRCSLLTEVETP1 | 2350 |
| 882 | 1CETPIRNEWG1LTEVETPIRCSLLTEVETP1 | 2282 |
| 842 | 1CSLLTEVETP1TEVETPIRNCSLLTEVETP1 | 2591 |
| 883 | 1CLLTEVETPI1TEVETPIRNCSLLTEVETP1 | 2492 |
| 880 | 1CLTEVETPIR1TEVETPIRNCSLLTEVETP1 | 2396 |
| 887 | 1CTEVETPIRN1TEVETPIRNCSLLTEVETP1 | 2405 |
| 921 | 1CEVETPIRNE1TEVETPIRNCSLLTEVETP1 | 2272 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 953 | 1CVETPIRNEW1TEVETPIRNCSLLTEVETP1 | 2118 |
| 919 | 1CETPIRNEWG1TEVETPIRNCSLLTEVETP1 | 2223 |
| 869 | 1CSLLTEVETP1EVETPIRNECSLLTEVETP1 | 2582 |
| 967 | 1CLLTEVETPI1EVETPIRNECSLLTEVETP1 | 2220 |
| 961 | 1CLTEVETPIR1EVETPIRNECSLLTEVETP1 | 2331 |
| 978 | 1CTEVETPIRN1EVETPIRNECSLLTEVETP1 | 2295 |
| 870 | 1CEVETPIRNE1EVETPIRNECSLLTEVETP1 | 2618 |
| 963 | 1CVETPIRNEW1EVETPIRNECSLLTEVETP1 | 2365 |
| 936 | 1CETPIRNEWG1EVETPIRNECSLLTEVETP1 | 2368 |
| 851 | 1CSLLTEVETP1VETPIRNEWCSLLTEVETP1 | 2708 |
| 943 | 1CLLTEVETPI1VETPIRNEWCSLLTEVETP1 | 2422 |
| 932 | 1CLTEVETPIR1VETPIRNEWCSLLTEVETP1 | 2344 |
| 952 | 1CTEVETPIRN1VETPIRNEWCSLLTEVETP1 | 2380 |
| 934 | 1CEVETPIRNE1VETPIRNEWCSLLTEVETP1 | 2448 |
| 955 | 1CVETPIRNEW1VETPIRNEWCSLLTEVETP1 | 2307 |
| 929 | 1CETPIRNEWG1VETPIRNEWCSLLTEVETP1 | 2419 |
| 885 | 1CSLLTEVETP1ETPIRNEWGCSLLTEVETP1 | 2591 |
| 968 | 1CLLTEVETPI1ETPIRNEWGCSLLTEVETP1 | 2377 |
| 902 | 1CLTEVETPIR1ETPIRNEWGCSLLTEVETP1 | 2296 |
| 1405 | 1CTEVETPIRN1ETPIRNEWGCSLLTEVETP1 | 2268 |
| 903 | 1CEVETPIRNE1ETPIRNEWGCSLLTEVETP1 | 2140 |
| 877 | 1CVETPIRNEW1ETPIRNEWGCSLLTEVETP1 | 2349 |
| 896 | 1CETPIRNEWG1ETPIRNEWGCSLLTEVETP1 | 2425 |
| 830 | 1CSLLTEVETP1SLLTEVETPCLLTEVETPI1 | 2786 |
| 847 | 1CLLTEVETPI1SLLTEVETPCLLTEVETPI1 | 2722 |
| 832 | 1CLTEVETPIR1SLLTEVETPCLLTEVETPI1 | 2711 |
| 838 | 1CTEVETPIRN1SLLTEVETPCLLTEVETPI1 | 2616 |
| 855 | 1CEVETPIRNE1SLLTEVETPCLLTEVETPI1 | 2576 |
| 871 | 1CVETPIRNEW1SLLTEVETPCLLTEVETPI1 | 2544 |
| 837 | 1CETPIRNEWG1SLLTEVETPCLLTEVETPI1 | 2653 |
| 923 | 1CSLLTEVETP1LLTEVETPICLLTEVETPI1 | 2534 |
| 1406 | 1CLLTEVETPI1LLTEVETPICLLTEVETPI1 | 2350 |
| 1407 | 1CLTEVETPIR1LLTEVETPICLLTEVETPI1 | 2316 |
| 1408 | 1CTEVETPIRN1LLTEVETPICLLTEVETPI1 | 2446 |
| 1409 | 1CEVETPIRNE1LLTEVETPICLLTEVETPI1 | 2194 |
| 1410 | 1CVETPIRNEW1LLTEVETPICLLTEVETPI1 | 2331 |
| 1411 | 1CETPIRNEWG1LLTEVETPICLLTEVETPI1 | 2405 |
| 916 | 1CSLLTEVETP1LTEVETPIRCLLTEVETPI1 | 2722 |
| 1412 | 1CLLTEVETPI1LTEVETPIRCLLTEVETPI1 | 2436 |
| 1413 | 1CLTEVETPIR1LTEVETPIRCLLTEVETPI1 | 1445 |
| 1414 | 1CTEVETPIRN1LTEVETPIRCLLTEVETPI1 | 1793 |
| 1415 | 1CEVETPIRNE1LTEVETPIRCLLTEVETPI1 | 1407 |
| 1416 | 1CVETPIRNEW1LTEVETPIRCLLTEVETPI1 | 1369 |
| 1417 | 1CETPIRNEWG1LTEVETPIRCLLTEVETPI1 | 1474 |
| 878 | 1CSLLTEVETP1TEVETPIRNCLLTEVETPI1 | 2664 |
| 1418 | 1CLLTEVETPI1TEVETPIRNCLLTEVETPI1 | 2371 |
| 1419 | 1CLTEVETPIR1TEVETPIRNCLLTEVETPI1 | 1907 |
| 1420 | 1CTEVETPIRN1TEVETPIRNCLLTEVETPI1 | 1905 |
| 1421 | 1CEVETPIRNE1TEVETPIRNCLLTEVETPI1 | 1469 |
| 1422 | 1CVETPIRNEW1TEVETPIRNCLLTEVETPI1 | 1452 |
| 1423 | 1CETPIRNEWG1TEVETPIRNCLLTEVETPI1 | 1735 |
| 889 | 1CSLLTEVETP1EVETPIRNECLLTEVETPI1 | 2595 |
| 1424 | 1CLLTEVETPI1EVETPIRNECLLTEVETPI1 | 2331 |
| 1425 | 1CLTEVETPIR1EVETPIRNECLLTEVETPI1 | 1049 |
| 1426 | 1CTEVETPIRN1EVETPIRNECLLTEVETPI1 | 1107 |
| 873 | 1CSLLTEVETP1VETPIRNEWCLLTEVETPI1 | 2767 |
| 1427 | 1CLLTEVETPI1VETPIRNEWCLLTEVETPI1 | 2410 |
| 1428 | 1CLTEVETPIR1VETPIRNEWCLLTEVETPI1 | 1465 |
| 1429 | 1CTEVETPIRN1VETPIRNEWCLLTEVETPI1 | 1559 |
| 1430 | 1CEVETPIRNE1VETPIRNEWCLLTEVETPI1 | 1477 |
| 1431 | 1CVETPIRNEW1VETPIRNEWCLLTEVETPI1 | 1588 |
| 1432 | 1CETPIRNEWG1VETPIRNEWCLLTEVETPI1 | 1453 |
| 937 | 1CSLLTEVETP1ETPIRNEWGCLLTEVETPI1 | 2646 |
| 1433 | 1CLLTEVETPI1ETPIRNEWGCLLTEVETPI1 | 2361 |
| 1434 | 1CLTEVETPIR1ETPIRNEWGCLLTEVETPI1 | 1699 |
| 1435 | 1CTEVETPIRN1ETPIRNEWGCLLTEVETPI1 | 1573 |
| 1436 | 1CEVETPIRNE1ETPIRNEWGCLLTEVETPI1 | 1434 |
| 1437 | 1CVETPIRNEW1ETPIRNEWGCLLTEVETPI1 | 1582 |
| 1438 | 1CETPIRNEWG1ETPIRNEWGCLLTEVETPI1 | 1968 |
| 1439 | 1CSLLTEVETP1SLLTEVETPCLTEVETPIR1 | 2738 |
| 949 | 1CLLTEVETPI1SLLTEVETPCLTEVETPIR1 | 2403 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 857 | 1CLTEVETPIR1SLLTEVETPCLTEVETPIR1 | 2755 |
| 1440 | 1CTEVETPIRN1SLLTEVETPCLTEVETPIR1 | 2705 |
| 897 | 1CEVETPIRNE1SLLTEVETPCLTEVETPIR1 | 2565 |
| 843 | 1CVETPIRNEW1SLLTEVETPCLTEVETPIR1 | 2498 |
| 910 | 1CETPIRNEWG1SLLTEVETPCLTEVETPIR1 | 2473 |
| 892 | 1CSLLTEVETP1LLTEVETPICLTEVETPIR1 | 2546 |
| 1441 | 1CLLTEVETPI1LLTEVETPICLTEVETPIR1 | 2288 |
| 1442 | 1CLTEVETPIR1LLTEVETPICLTEVETPIR1 | 2057 |
| 1443 | 1CTEVETPIRN1LLTEVETPICLTEVETPIR1 | 2213 |
| 1444 | 1CEVETPIRNE1LLTEVETPICLTEVETPIR1 | 2000 |
| 1445 | 1CVETPIRNEW1LLTEVETPICLTEVETPIR1 | 2280 |
| 1446 | 1CETPIRNEWG1LLTEVETPICLTEVETPIR1 | 2367 |
| 886 | 1CSLLTEVETP1LTEVETPIRCLTEVETPIR1 | 2623 |
| 1447 | 1CLLTEVETPI1LTEVETPIRCLTEVETPIR1 | 2283 |
| 944 | 1CSLLTEVETP1TEVETPIRNCLTEVETPIR1 | 2646 |
| 1448 | 1CLLTEVETPI1TEVETPIRNCLTEVETPIR1 | 2440 |
| 1449 | 1CSLLTEVETP1EVETPIRNECLTEVETPIR1 | 2404 |
| 1450 | 1CLLTEVETPI1EVETPIRNECLTEVETPIR1 | 2188 |
| 1451 | 1CSLLTEVETP1VETPIRNEWCLTEVETPIR1 | 2549 |
| 1452 | 1CLLTEVETPI1VETPIRNEWCLTEVETPIR1 | 2607 |
| 1453 | 1CSLLTEVETP1ETPIRNEWGCLTEVETPIR1 | 2465 |
| 1454 | 1CLLTEVETPI1ETPIRNEWGCLTEVETPIR1 | 2218 |
| 918 | 1CSLLTEVETP1SLLTEVETPCTEVETPIRN1 | 2618 |
| 1455 | 1CLLTEVETPI1SLLTEVETPCTEVETPIRN1 | 2283 |
| 946 | 1CLTEVETPIR1SLLTEVETPCTEVETPIRN1 | 2434 |
| 957 | 1CTEVETPIRN1SLLTEVETPCTEVETPIRN1 | 2402 |
| 941 | 1CEVETPIRNE1SLLTEVETPCTEVETPIRN1 | 2692 |
| 947 | 1CVETPIRNEW1SLLTEVETPCTEVETPIRN1 | 2733 |
| 942 | 1CETPIRNEWG1SLLTEVETPCTEVETPIRN1 | 2601 |
| 1456 | 1CSLLTEVETP1LLTEVETPICTEVETPIRN1 | 2103 |
| 1457 | 1CLLTEVETPI1LLTEVETPICTEVETPIRN1 | 1884 |
| 1458 | 1CLTEVETPIR1LLTEVETPICTEVETPIRN1 | 1756 |
| 1459 | 1CTEVETPIRN1LLTEVETPICTEVETPIRN1 | 1749 |
| 1460 | 1CEVETPIRNE1LLTEVETPICTEVETPIRN1 | 1620 |
| 1461 | 1CVETPIRNEW1LLTEVETPICTEVETPIRN1 | 1835 |
| 1462 | 1CETPIRNEWG1LLTEVETPICTEVETPIRN1 | 1710 |
| 971 | 1CSLLTEVETP1LTEVETPIRCTEVETPIRN1 | 2360 |
| 1463 | 1CLLTEVETPI1LTEVETPIRCTEVETPIRN1 | 2188 |
| 1464 | 1CSLLTEVETP1TEVETPIRNCTEVETPIRN1 | 2755 |
| 1465 | 1CLLTEVETPI1TEVETPIRNCTEVETPIRN1 | 2488 |
| 1466 | 1CSLLTEVETP1EVETPIRNECTEVETPIRN1 | 2134 |
| 1467 | 1CLLTEVETPI1EVETPIRNECTEVETPIRN1 | 1851 |
| 1468 | 1CSLLTEVETP1VETPIRNEWCTEVETPIRN1 | 2301 |
| 1469 | 1CLLTEVETPI1VETPIRNEWCTEVETPIRN1 | 1713 |
| 1470 | 1CSLLTEVETP1ETPIRNEWGCTEVETPIRN1 | 2331 |
| 1471 | 1CLLTEVETPI1ETPIRNEWGCTEVETPIRN1 | 1983 |
| 958 | 1CSLLTEVETP1SLLTEVETPCEVETPIRNE1 | 2203 |
| 1472 | 1CLLTEVETPI1SLLTEVETPCEVETPIRNE1 | 2057 |
| 976 | 1CLTEVETPIR1SLLTEVETPCEVETPIRNE1 | 2216 |
| 913 | 1CTEVETPIRN1SLLTEVETPCEVETPIRNE1 | 2139 |
| 1473 | 1CEVETPIRNE1SLLTEVETPCEVETPIRNE1 | 2006 |
| 1474 | 1CVETPIRNEW1SLLTEVETPCEVETPIRNE1 | 1986 |
| 1475 | 1CETPIRNEWG1SLLTEVETPCEVETPIRNE1 | 2642 |
| 1476 | 1CSLLTEVETP1LLTEVETPICEVETPIRNE1 | 2472 |
| 1477 | 1CLLTEVETPI1LLTEVETPICEVETPIRNE1 | 2022 |
| 1478 | 1CLTEVETPIR1LLTEVETPICEVETPIRNE1 | 1681 |
| 1479 | 1CTEVETPIRN1LLTEVETPICEVETPIRNE1 | 1627 |
| 1480 | 1CEVETPIRNE1LLTEVETPICEVETPIRNE1 | 1394 |
| 1481 | 1CVETPIRNEW1LLTEVETPICEVETPIRNE1 | 1592 |
| 1482 | 1CETPIRNEWG1LLTEVETPICEVETPIRNE1 | 1648 |
| 1483 | 1CSLLTEVETP1LTEVETPIRCEVETPIRNE1 | 2040 |
| 1484 | 1CLLTEVETPI1LTEVETPIRCEVETPIRNE1 | 1777 |
| 1485 | 1CSLLTEVETP1TEVETPIRNCEVETPIRNE1 | 2036 |
| 1486 | 1CLLTEVETPI1TEVETPIRNCEVETPIRNE1 | 1798 |
| 1487 | 1CSLLTEVETP1EVETPIRNECEVETPIRNE1 | 1917 |
| 1488 | 1CLLTEVETPI1EVETPIRNECEVETPIRNE1 | 1631 |
| 1489 | 1CSLLTEVETP1VETPIRNEWCEVETPIRNE1 | 2359 |
| 1490 | 1CLLTEVETPI1VETPIRNEWCEVETPIRNE1 | 1730 |
| 1491 | 1CSLLTEVETP1ETPIRNEWGCEVETPIRNE1 | 2338 |
| 1492 | 1CLLTEVETPI1ETPIRNEWGCEVETPIRNE1 | 1781 |
| 850 | 1CSLLTEVETP1SLLTEVETPCVETPIRNEW1 | 2491 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 975 | 1CLLTEVETPI1SLLTEVETPCVETPIRNEW1 | 2316 |
| 945 | 1CLTEVETPIR1SLLTEVETPCVETPIRNEW1 | 2366 |
| 951 | 1CTEVETPIRN1SLLTEVETPCVETPIRNEW1 | 2460 |
| 959 | 1CEVETPIRNE1SLLTEVETPCVETPIRNEW1 | 2441 |
| 935 | 1CVETPIRNEW1SLLTEVETPCVETPIRNEW1 | 2470 |
| 950 | 1CETPIRNEWG1SLLTEVETPCVETPIRNEW1 | 2465 |
| 974 | 1CSLLTEVETP1LLTEVETPICVETPIRNEW1 | 2285 |
| 1493 | 1CLLTEVETPI1LLTEVETPICVETPIRNEW1 | 2661 |
| 1494 | 1CLTEVETPIR1LLTEVETPICVETPIRNEW1 | 2443 |
| 1495 | 1CTEVETPIRN1LLTEVETPICVETPIRNEW1 | 2088 |
| 1496 | 1CEVETPIRNE1LLTEVETPICVETPIRNEW1 | 1625 |
| 1497 | 1CVETPIRNEW1LLTEVETPICVETPIRNEW1 | 1817 |
| 1498 | 1CETPIRNEWG1LLTEVETPICVETPIRNEW1 | 1817 |
| 1499 | 1CSLLTEVETP1LTEVETPIRCVETPIRNEW1 | 2319 |
| 1500 | 1CLLTEVETPI1LTEVETPIRCVETPIRNEW1 | 2171 |
| 1501 | 1CSLLTEVETP1TEVETPIRNCVETPIRNEW1 | 2497 |
| 1502 | 1CLLTEVETPI1TEVETPIRNCVETPIRNEW1 | 2229 |
| 1503 | 1CSLLTEVETP1EVETPIRNECVETPIRNEW1 | 2469 |
| 1504 | 1CLLTEVETPI1EVETPIRNECVETPIRNEW1 | 2081 |
| 1505 | 1CSLLTEVETP1VETPIRNEWCVETPIRNEW1 | 2398 |
| 1506 | 1CLLTEVETPI1VETPIRNEWCVETPIRNEW1 | 2074 |
| 1507 | 1CSLLTEVETP1ETPIRNEWGCVETPIRNEW1 | 2778 |
| 1508 | 1CLLTEVETPI1ETPIRNEWGCVETPIRNEW1 | 2495 |
| 845 | 1CSLLTEVETP1SLLTEVETPCETPIRNEWG1 | 2417 |
| 1509 | 1CLLTEVETPI1SLLTEVETPCETPIRNEWG1 | 2057 |
| 962 | 1CLTEVETPIR1SLLTEVETPCETPIRNEWG1 | 2230 |
| 956 | 1CTEVETPIRN1SLLTEVETPCETPIRNEWG1 | 2352 |
| 868 | 1CEVETPIRNE1SLLTEVETPCETPIRNEWG1 | 2326 |
| 866 | 1CVETPIRNEW1SLLTEVETPCETPIRNEWG1 | 2328 |
| 964 | 1CETPIRNEWG1SLLTEVETPCETPIRNEWG1 | 2357 |
| 939 | 1CSLLTEVETP1LLTEVETPICETPIRNEWG1 | 2446 |
| 1510 | 1CLLTEVETPI1LLTEVETPICETPIRNEWG1 | 1999 |
| 1511 | 1CLTEVETPIR1LLTEVETPICETPIRNEWG1 | 2175 |
| 1512 | 1CTEVETPIRN1LLTEVETPICETPIRNEWG1 | 2645 |
| 1513 | 1CEVETPIRNE1LLTEVETPICETPIRNEWG1 | 2466 |
| 1514 | 1CVETPIRNEW1LLTEVETPICETPIRNEWG1 | 2575 |
| 1515 | 1CETPIRNEWG1LLTEVETPICETPIRNEWG1 | 2427 |
| 972 | 1CSLLTEVETP1LTEVETPIRCETPIRNEWG1 | 2583 |
| 1516 | 1CLLTEVETPI1LTEVETPIRCETPIRNEWG1 | 2320 |
| 1517 | 1CSLLTEVETP1TEVETPIRNCETPIRNEWG1 | 2299 |
| 1518 | 1CLLTEVETPI1TEVETPIRNCETPIRNEWG1 | 1972 |
| 1519 | 1CSLLTEVETP1EVETPIRNECETPIRNEWG1 | 2692 |
| 1520 | 1CLLTEVETPI1EVETPIRNECETPIRNEWG1 | 2433 |
| 1521 | 1CSLLTEVETP1VETPIRNEWCETPIRNEWG1 | 2569 |
| 1522 | 1CLLTEVETPI1VETPIRNEWCETPIRNEWG1 | 1931 |
| 1523 | 1CSLLTEVETP1ETPIRNEWGCETPIRNEWG1 | 2340 |
| 1524 | 1CLLTEVETPI1ETPIRNEWGCETPIRNEWG1 | 2007 |
| 861 | SLLTEVET1CSLLTEVET1SLLTEVETCSLLTE1 | 2691 |
| 853 | SLLTEVET1CSLLTEVET1SLLTEVETCLLTEV1 | 2690 |
| 901 | SLLTEVET1CSLLTEVET1SLLTEVETCLTEVE1 | 2396 |
| 915 | SLLTEVET1CSLLTEVET1SLLTEVETCTEVET1 | 2218 |
| 914 | SLLTEVET1CSLLTEVET1SLLTEVETCEVETP1 | 2268 |
| 893 | SLLTEVET1CSLLTEVET1SLLTEVETCVETPI1 | 2422 |
| 890 | SLLTEVET1CSLLTEVET1SLLTEVETCETPIR1 | 2507 |
| 862 | SLLTEVET1CSLLTEVET1SLLTEVETCTPIRN1 | 2690 |
| 907 | SLLTEVET1CSLLTEVET1SLLTEVETCPIRNE1 | 2435 |
| 852 | SLLTEVET1CSLLTEVET1SLLTEVETCIRNEW1 | 2663 |
| 895 | SLLTEVET1CSLLTEVET1SLLTEVETCRNEWG1 | 2476 |
| 908 | SLLTEVET1CSLLTEVET1SLLTEVETCNEWG1 | 2461 |
| 834 | SLLTEVET1CSLLTEVET1SLLTEVETCEWG1R | 2855 |
| 835 | SLLTEVET1CSLLTEVET1SLLTEVETAWGCR1 | 2870 |
| 844 | SLLTEVET1CSLLTEVET1SLLTEVETAGCR1N | 2814 |
| 898 | SLLTEVET1CSLLTEVET1SLLTEVETACR1ND | 2686 |
| 908 | SLLTEVET1CSLLTEVET1SLLTEVETCNEWGS1 | 2726 |
| 840 | SLLTEVET1CSLLTEVET1SLLTEVETCEWGSR1 | 2730 |
| 1525 | CLLTEVETPIRNEWGSCVETPIRNEWGSRSNDC | 2278 |
| 938 | CSLLTEVETCETPIRNEWGSRSNDSC | 1916 |
| 922 | CSLLTEVETPCETPIRNEWGSRSNDSC | 2170 |
| 905 | CSLLTEVETPICETPIRNEWGSRSNDSC | 2041 |
| 911 | CSLLTEVETPIRCETPIRNEWGSRSNDSC | 2024 |
| 891 | CSLLTEVETPIRNCETPIRNEWGSRSNDSC | 1931 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 917 | CSLLTEVETPIRNECETPIRNEWGSRSNDSC | 1808 |
| 1526 | CSLLTEVETPIRNEWCETPIRNEWGSRSNDSC | 2012 |
| 881 | CSLLTEVETPIRNEWGCETPIRNEWGSRSNDSC | 2501 |
| 1527 | CLLTEVETPIRNEWGSCETPIRNEWGSRSNDSC | 2414 |
| 894 | CSLLTEVETCTPIRNEWGSRSNDSSC | 2068 |
| 965 | CSLLTEVETPCTPIRNEWGSRSNDSSC | 2351 |
| 966 | CSLLTEVETPICTPIRNEWGSRSNDSSC | 2125 |
| 924 | CSLLTEVETPIRCTPIRNEWGSRSNDSSC | 2162 |
| 979 | CSLLTEVETPIRNCTPIRNEWGSRSNDSSC | 1927 |
| 920 | CSLLTEVETPIRNECTPIRNEWGSRSNDSSC | 1988 |
| 1528 | CSLLTEVETPIRNEWCTPIRNEWGSRSNDSSC | 1959 |
| 980 | CSLLTEVETPIRNEWGCTPIRNEWGSRSNDSSC | 2116 |
| 1529 | CLLTEVETPIRNEWGSCTPIRNEWGSRSNDSSC | 2268 |
| 888 | CSLLTEVETCPIRNEWGSRSNDSSDC | 2246 |
| 931 | CSLLTEVETPCPIRNEWGSRSNDSSDC | 2377 |
| 954 | CSLLTEVETPICPIRNEWGSRSNDSSDC | 2267 |
| 969 | CSLLTEVETPIRCPIRNEWGSRSNDSSDC | 2228 |
| 970 | CSLLTEVETPIRNCPIRNEWGSRSNDSSDC | 2089 |
| 973 | CSLLTEVETPIRNECPIRNEWGSRSNDSSDC | 1955 |
| 1530 | CSLLTEVETPIRNEWCPIRNEWGSRSNDSSDC | 1983 |
| 906 | CSLLTEVETPIRNEWGCPIRNEWGSRSNDSSDC | 1954 |
| 1531 | CLLTEVETPIRNEWGSCPIRNEWGSRSNDSSDC | 1420 |
| 875 | SLLTEVETCSLLTEVETCSLLTEVETPIRC | 2643 |
| 909 | SLLTEVETCSLLTEVETCLLTEVETPIRNC | 2618 |
| 960 | SLLTEVETCSLLTEVETCLTEVETPIRNEC | 2157 |
| 940 | SLLTEVETCSLLTEVETCTEVETPIRNEWC | 2302 |
| 930 | SLLTEVETCSLLTEVETCEVETPIRNEWGC | 2300 |
| 925 | SLLTEVETCSLLTEVETCVETPIRNEWGSC | 2347 |
| 927 | SLLTEVETCSLLTEVETCETPIRNEWGSRC | 2311 |
| 912 | SLLTEVETCSLLTEVETCTPIRNEWGSRSC | 2434 |
| 933 | SLLTEVETCSLLTEVETCPIRNEWGSRSNC | 2192 |
| 948 | SLLTEVETCSLLTEVETCIRNEWGSRSNDC | 1961 |
| 884 | SLLTEVETCSLLTEVETCRNEWGSRSNDSC | 2620 |
| 846 | SLLTEVETCSLLTEVETCNEWGSRSNDSSC | 2640 |
| 874 | SLLTEVETCSLLTEVETCEWGSRSNDSSDC | 2509 |
| 856 | SLLTEVETCSLLTEVETCVETPIRNEWGC | 2671 |
| 879 | SLLTEVETCSLLTEVETCETPIRNEWGCR | 2631 |
| 833 | SLLTEVETCSLLTEVETATPIRNEWGCRC | 2640 |
| 899 | SLLTEVETCSLLTEVETAPIRNEWGCRCN | 2576 |
| 904 | SLLTEVETCSLLTEVETAIRNEWGCRCND | 2538 |
| 926 | SLLTEVETCSLLTEVETARNEWGCRCNDS | 2463 |
| 928 | SLLTEVETCSLLTEVETANEWGCRCNDSS | 2358 |
| 865 | SLLTEVETCSLLTEVETAEWGCRCNDSSD | 2254 |
| 1532 | CSLLTEVETPIRNEWGCRCNDSSD | 2284 |
| 1533 | CLLTEVETPIRNEWGCRCNDSSD | 1979 |
| 1534 | SLLCEVETPIRNEWGCRCNDSSD | 2161 |
| 566 | SLLTEVCTPIRNEWGCRCNDSSD | 1210 |
| 718 | SLLTEVECPIRNEWGCRCNDSSD | 1974 |
| 623 | SLLTEVETCIRNEWGCRCNDSSD | 1992 |
| 687 | SLLTEVETPCRNEWGCRCNDSSD | 2050 |
| 725 | SLLTEVETPICNEWGCRCNDSSD | 2005 |
| 587 | SLLTEVETPIRCEWGCRCNDSSD | 1956 |
| 733 | SLLTEVETPIRNCWGCRCNDSSD | 2006 |
| 268 | SLLTEVETPIRNECGCRCNDSSD | 2554 |
| 714 | SLLTEVETPIRNEWCCRCNDSSD | 2388 |
| 127 | CSLLTEVETCSLLTEVETC | 2555 |
| 198 | CSLLTEVETPCSLLTEVETC | 2341 |
| 187 | CSLLTEVETPICSLLTEVETC | 2554 |
| 147 | CSLLTEVETPIRCSLLTEVETC | 2662 |
| 166 | CSLLTEVETPIRNCSLLTEVETC | 2538 |
| 118 | CSLLTEVETPIRNECSLLTEVETC | 2489 |
| 122 | CSLLTEVETPIRNEWCSLLTEVETC | 2454 |
| 200 | CSLLTEVETPIRNEWGCSLLTEVETC | 2371 |
| 254 | CLLTEVETPIRNEWGCSLLTEVETC | 2177 |
| 136 | CLTEVETPIRNEWGSRCSLLTEVETC | 2026 |
| 226 | CTEVETPIRNEWGSRSCSLLTEVETC | 2140 |
| 201 | CEVETPIRNEWGSRSNCSLLTEVETC | 2288 |
| 223 | CVETPIRNEWGSRSNDCSLLTEVETC | 2233 |
| 213 | CETPIRNEWGSRSNDCSLLTEVETC | 1997 |
| 230 | CTPIRNEWGSRSNDSSCSLLTEVETC | 2168 |
| 161 | CPIRNEWGSRSNDSSDCSLLTEVETC | 2759 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 142 | CSLLTEVETCSLLTEVETPC | 2716 |
| 156 | CSLLTEVETPCSLLTEVETPC | 2673 |
| 207 | CSLLTEVETPICSLLTEVETPC | 2440 |
| 181 | CSLLTEVETPIRCSLLTEVETPC | 2448 |
| 144 | CSLLTEVETPIRNCSLLTEVETPC | 2673 |
| 164 | CSLLTEVETPIRNECSLLTEVETPC | 2582 |
| 189 | CSLLTEVETPIRNEWCSLLTEVETPC | 2505 |
| 217 | CSLLTEVETPIRNEWGCSLLTEVETPC | 2445 |
| 270 | CLLTEVETPIRNEWGSCSLLTEVETPC | 2307 |
| 228 | CLTEVETPIRNEWGSRCSLLTEVETPC | 2237 |
| 246 | CTEVETPIRNEWGSRSCSLLTEVETPC | 2182 |
| 229 | CEVETPIRNEWGSRSNCSLLTEVETPC | 2290 |
| 242 | CVETPIRNEWGSRSNDCSLLTEVETPC | 2379 |
| 232 | CETPIRNEWGSRSNDSCSLLTEVETPC | 2425 |
| 247 | CTPIRNEWGSRSNDSSCSLLTEVETPC | 2249 |
| 259 | CPIRNEWGSRSNDSSDCSLLTEVETPC | 2441 |
| 128 | CSLLTEVETCSLLTEVETPIC | 2876 |
| 137 | CSLLTEVETPCSLLTEVETPIC | 2815 |
| 245 | CSLLTEVETPICSLLTEVETPIC | 2492 |
| 151 | CSLLTEVETPIRCSLLTEVETPIC | 2561 |
| 139 | CSLLTEVETPIRNCSLLTEVETPIC | 2666 |
| 145 | CSLLTEVETPIRNECSLLTEVETPIC | 2684 |
| 177 | CSLLTEVETPIRNEWCSLLTEVETPIC | 2548 |
| 197 | CSLLTEVETPIRNEWGCSLLTEVETPIC | 2481 |
| 252 | CLLTEVETPIRNEWGSCSLLTEVETPIC | 2333 |
| 191 | CLTEVETPIRNEWGSRCSLLTEVETPIC | 2405 |
| 216 | CTEVETPIRNEWGSRSCSLLTEVETPIC | 2308 |
| 219 | CEVETPIRNEWGSRSNCSLLTEVETPIC | 2363 |
| 132 | CVETPIRNEWGSRSNDCSLLTEVETPIC | 2372 |
| 237 | CETPIRNEWGSRSNDSCSLLTEVETPIC | 2436 |
| 231 | CTPIRNEWGSRSNDSSCSLLTEVETPIC | 2460 |
| 267 | CPIRNEWGSRSNDSSDCSLLTEVETPIC | 2227 |
| 163 | CSLLTEVETCSLLTEVETPIRC | 2531 |
| 124 | CSLLTEVETPCSLLTEVETPIRC | 2839 |
| 203 | CSLLTEVETPICSLLTEVETPIRC | 2628 |
| 121 | CSLLTEVETPIRCSLLTEVETPIRC | 2767 |
| 120 | CSLLTEVETPIRNCSLLTEVETPIRC | 2751 |
| 130 | CSLLTEVETPIRNECSLLTEVETPIRC | 2751 |
| 155 | CSLLTEVETPIRNEWCSLLTEVETPIRC | 2646 |
| 157 | CSLLTEVETPIRNEWGCSLLTEVETPIRC | 2619 |
| 117 | CLLTEVETPIRNEWGSCSLLTEVETPIRC | 2622 |
| 162 | CLTEVETPIRNEWGSRCSLLTEVETPIRC | 2476 |
| 184 | CTEVETPIRNEWGSRSCSLLTEVETPIRC | 2419 |
| 172 | CEVETPIRNEWGSRSNCSLLTEVETPIRC | 2467 |
| 168 | CVETPIRNEWGSRSNDCSLLTEVETPIRC | 2484 |
| 190 | CETPIRNEWGSRSNDSCSLLTEVETPIRC | 2514 |
| 169 | CTPIRNEWGSRSNDSSCSLLTEVETPIRC | 2518 |
| 176 | CPIRNEWGSRSNDSSDCSLLTEVETPIRC | 2586 |
| 134 | CSLLTEVETCSLLTEVETPIRNC | 2633 |
| 153 | CSLLTEVETPCSLLTEVETPIRNC | 2691 |
| 208 | CSLLTEVETPICSLLTEVETPIRNC | 2548 |
| 131 | CSLLTEVETPIRCSLLTEVETPIRNC | 2753 |
| 129 | CSLLTEVETPIRNCSLLTEVETPIRNC | 2748 |
| 133 | CSLLTEVETPIRNECSLLTEVETPIRNC | 2724 |
| 180 | CSLLTEVETPIRNEWCSLLTEVETPIRNC | 2538 |
| 143 | CSLLTEVETPIRNEWGCSLLTEVETPIRNC | 2657 |
| 178 | CLLTEVETPIRNEWGSCSLLTEVETPIRNC | 2574 |
| 119 | CLTEVETPIRNEWGSRCSLLTEVETPIRNC | 2459 |
| 204 | CTEVETPIRNEWGSRSCSLLTEVETPIRNC | 2358 |
| 196 | CEVETPIRNEWGSRSNCSLLTEVETPIRNC | 2429 |
| 194 | CVETPIRNEWGSRSNDCSLLTEVETPIRNC | 2440 |
| 126 | CETPIRNEWGSRSNDSCSLLTEVETPIRNC | 2440 |
| 185 | CTPIRNEWGSRSNDSSCSLLTEVETPIRNC | 2492 |
| 202 | CPIRNEWGSRSNDSSDCSLLTEVETPIRNC | 2500 |
| 171 | CSLLTEVETCSLLTEVETPIRNEC | 2424 |
| 193 | CSLLTEVETPCSLLTEVETPIRNEC | 2387 |
| 1535 | CSLLTEVETPICSLLTEVETPIRNEC | 1851 |
| 165 | CSLLTEVETPIRCSLLTEVETPIRNEC | 2648 |
| 183 | CSLLTEVETPIRNCSLLTEVETPIRNEC | 2580 |
| 220 | CSLLTEVETPIRNECSLLTEVETPIRNEC | 2522 |
| 241 | CSLLTEVETPIRNEWCSLLTEVETPIRNEC | 2349 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
| --- | --- | --- |
| 206 | CSLLTEVETPIRNEWGCSLLTEVETPIRNEC | 2419 |
| 244 | CLLTEVETPIRNEWGSCSLLTEVETPIRNEC | 2327 |
| 240 | CLTEVETPIRNEWGSRCSLLTEVETPIRNEC | 2221 |
| 261 | CTEVETPIRNEWGSRSCSLLTEVETPIRNEC | 2074 |
| 273 | CEVETPIRNEWGSRSNCSLLTEVETPIRNEC | 2008 |
| 269 | CVETPIRNEWGSRSNDCSLLTEVETPIRNEC | 2140 |
| 154 | CETPIRNEWGSRSNDSCSLLTEVETPIRNEC | 2122 |
| 266 | CTPIRNEWGSRSNDSSCSLLTEVETPIRNEC | 2080 |
| 248 | CPIRNEWGSRSNDSSDCSLLTEVETPIRNEC | 2249 |
| 150 | CSLLTEVETCSLLTEVETPIRNEWC | 2577 |
| 158 | CSLLTEVETPCSLLTEVETPIRNEWC | 2567 |
| 211 | CSLLTEVETPICSLLTEVETPIRNEWC | 2423 |
| 173 | CSLLTEVETPIRCSLLTEVETPIRNEWC | 2566 |
| 135 | CSLLTEVETPIRNCSLLTEVETPIRNEWC | 2820 |
| 146 | CSLLTEVETPIRNECSLLTEVETPIRNEWC | 2720 |
| 174 | CSLLTEVETPIRNEWCSLLTEVETPIRNEWC | 2647 |
| 212 | CSLLTEVETPIRNEWGCSLLTEVETPIRNEWC | 2545 |
| 218 | CLLTEVETPIRNEWGSCSLLTEVETPIRNEWC | 2541 |
| 188 | CLTEVETPIRNEWGSRCSLLTEVETPIRNEWC | 2522 |
| 225 | CTEVETPIRNEWGSRSCSLLTEVETPIRNEWC | 2482 |
| 238 | CEVETPIRNEWGSRSNCSLLTEVETPIRNEWC | 2391 |
| 234 | CVETPIRNEWGSRSNDCSLLTEVETPIRNEWC | 2412 |
| 251 | CETPIRNEWGSRSNDSCSLLTEVETPIRNEWC | 2374 |
| 272 | CTPIRNEWGSRSNDSSCSLLTEVETPIRNEWC | 2313 |
| 249 | CPIRNEWGSRSNDSSDCSLLTEVETPIRNEWC | 2397 |
| 281 | CSLLTEVETCSLLTEVETPIRNEWGC | 2479 |
| 186 | CSLLTEVETPCSLLTEVETPIRNEWGC | 2523 |
| 236 | CSLLTEVETPICSLLTEVETPIRNEWGC | 2345 |
| 167 | CSLLTEVETPIRCSLLTEVETPIRNEWGC | 2600 |
| 148 | CSLLTEVETPIRNCSLLTEVETPIRNEWGC | 2553 |
| 152 | CSLLTEVETPIRNECSLLTEVETPIRNEWGC | 2732 |
| 141 | CSLLTEVETPIRNEWCSLLTEVETPIRNEWGC | 2669 |
| 140 | CSLLTEVETPIRNEWGCSLLTEVETPIRNEWGC | 2678 |
| 205 | CLLTEVETPIRNEWGSCSLLTEVETPIRNEWGC | 2593 |
| 116 | CLTEVETPIRNEWGSRCSLLTEVETPIRNEWGC | 2492 |
| 125 | CTEVETPIRNEWGSRSCSLLTEVETPIRNEWGC | 2449 |
| 233 | CEVETPIRNEWGSRSNCSLLTEVETPIRNEWGC | 2442 |
| 257 | CVETPIRNEWGSRSNDCSLLTEVETPIRNEWGC | 2400 |
| 255 | CETPIRNEWGSRSNDSCSLLTEVETPIRNEWGC | 2414 |
| 243 | CTPIRNEWGSRSNDSSCSLLTEVETPIRNEWGC | 2466 |
| 256 | CPIRNEWGSRSNDSSDCSLLTEVETPIRNEWGC | 2460 |
| 179 | CSLLTEVETCLLTEVETPIRNEWGSC | 2416 |
| 182 | CSLLTEVETPCLLTEVETPIRNEWGSC | 2540 |
| 224 | CSLLTEVETPICLLTEVETPIRNEWGSC | 2388 |
| 160 | CSLLTEVETPIRCLLTEVETPIRNEWGSC | 2520 |
| 192 | CSLLTEVETPIRNCLLTEVETPIRNEWGSC | 2519 |
| 227 | CSLLTEVETPIRNECLLTEVETPIRNEWGSC | 2484 |
| 214 | CSLLTEVETPIRNEWCLLTEVETPIRNEWGSC | 2661 |
| 138 | CSLLTEVETPIRNEWGCLLTEVETPIRNEWGSC | 2624 |
| 1536 | CLLTEVETPIRNEWGSCLLTEVETPIRNEWGSC | 2616 |
| 1537 | CLTEVETPIRNEWGSRCLLTEVETPIRNEWGSC | 2667 |
| 1538 | CTEVETPIRNEWGSRSCLLTEVETPIRNEWGSC | 2425 |
| 1539 | CEVETPIRNEWGSRSNCLLTEVETPIRNEWGSC | 2461 |
| 1540 | CVETPIRNEWGSRSNDCLLTEVETPIRNEWGSC | 2218 |
| 1541 | CETPIRNEWGSRSNDSCLLTEVETPIRNEWGSC | 2255 |
| 1542 | CTPIRNEWGSRSNDSSCLLTEVETPIRNEWGSC | 2363 |
| 1543 | CPIRNEWGSRSNDSSDCLLTEVETPIRNEWGSC | 2260 |
| 215 | CSLLTEVETCLTEVETPIRNEWGSRC | 2328 |
| 221 | CSLLTEVETPCLTEVETPIRNEWGSRC | 2513 |
| 235 | CSLLTEVETPICLTEVETPIRNEWGSRC | 2351 |
| 170 | CSLLTEVETPIRCLTEVETPIRNEWGSRC | 2587 |
| 195 | CSLLTEVETPIRNCLTEVETPIRNEWGSRC | 2585 |
| 123 | CSLLTEVETPIRNECLTEVETPIRNEWGSRC | 2496 |
| 278 | CSLLTEVETPIRNEWCLTEVETPIRNEWGSRC | 2429 |
| 175 | CSLLTEVETPIRNEWGCLTEVETPIRNEWGSRC | 2641 |
| 1544 | CLLTEVETPIRNEWGSCLTEVETPIRNEWGSRC | 2500 |
| 250 | CSLLTEVETCTEVETPIRNEWGSRSC | 2474 |
| 222 | CSLLTEVETPCTEVETPIRNEWGSRSC | 2703 |
| 280 | CSLLTEVETPICTEVETPIRNEWGSRSC | 2241 |
| 199 | CSLLTEVETPIRCTEVETPIRNEWGSRSC | 2623 |
| 210 | CSLLTEVETPIRNCTEVETPIRNEWGSRSC | 2643 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 258 | CSLLTEVETPIRNECTEVETPIRNEWGSRSC | 2553 |
| 277 | CSLLTEVETPIRNEWCTEVETPIRNEWGSRSC | 2388 |
| 263 | CSLLTEVETPIRNEWGCTEVETPIRNEWGSRSC | 2496 |
| 1545 | CLLTEVETPIRNEWGSCTEVETPIRNEWGSRSC | 2592 |
| 239 | CSLLTEVETCEVETPIRNEWGSRSNC | 2549 |
| 274 | CSLLTEVETPCEVETPIRNEWGSRSNC | 2701 |
| 260 | CSLLTEVETPICEVETPIRNEWGSRSNC | 2680 |
| 209 | CSLLTEVETPIRCEVETPIRNEWGSRSNC | 2699 |
| 253 | CSLLTEVETPIRNCEVETPIRNEWGSRSNC | 2699 |
| 276 | CSLLTEVETPIRNECEVETPIRNEWGSRSNC | 2620 |
| 1546 | CSLLTEVETPIRNEWCEVETPIRNEWGSRSNC | 2519 |
| 275 | CSLLTEVETPIRNEWGCEVETPIRNEWGSRSNC | 2397 |
| 1547 | CLLTEVETPIRNEWGSCEVETPIRNEWGSRSNC | 2074 |
| 264 | CSLLTEVETCVETPIRNEWGSRSNDC | 2374 |
| 265 | CSLLTEVETPCVETPIRNEWGSRSNDC | 2484 |
| 1548 | CSLLTEVETPICVETPIRNEWGSRSNDC | 2174 |
| 271 | CSLLTEVETPIRCVETPIRNEWGSRSNDC | 2480 |
| 262 | CSLLTEVETPIRNCVETPIRNEWGSRSNDC | 2566 |
| 279 | CSLLTEVETPIRNECVETPIRNEWGSRSNDC | 2465 |
| 1549 | CSLLTEVETPIRNEWCVETPIRNEWGSRSNDC | 2433 |
| 159 | CSLLTEVETPIRNEWGCVETPIRNEWGSRSNDC | 2415 |
| 320 | SLLTEVGSLLTEV | 2530 |
| 283 | CSLLTEVGSLLTEV | 2903 |
| 390 | CLLTEVGSLLTEV | 2494 |
| 500 | SCLTEVGSLLTEV | 1610 |
| 324 | SLCTEVGSLLTEV | 1780 |
| 336 | SLLCEVGSLLTEV | 2475 |
| 824 | SLLTCVGSLLTEV | 1772 |
| 482 | CLCTCVGSLLTEV | 1953 |
| 354 | SLLTEVGCSLLTEV | 2511 |
| 807 | CLLTEVGCSLLTEV | 1558 |
| 580 | SLCTEVGCSLLTEV | 2382 |
| 511 | SLLCEVGCSLLTEV | 2562 |
| 810 | SLLTCVGCSLLTEV | 1992 |
| 798 | CLCTCVGCSLLTEV | 1489 |
| 311 | SLLTEVGCLLTEV | 1924 |
| 388 | CSLLTEVGCLLTEV | 2427 |
| 1550 | SLLCEVGCLLTEV | 1997 |
| 302 | ASLLTEVGSCLTEV | 2770 |
| 345 | CSLLTEVGSCLTEV | 2703 |
| 1551 | SLLCEVGSCLTEV | 2499 |
| 464 | SLLTEVGSLCTEV | 2219 |
| 711 | CSLLTEVGSLCTEV | 2409 |
| 1552 | SLLCEVGSLCTEV | 2722 |
| 314 | SLLTEVGSLLCEV | 2392 |
| 792 | CSLLTEVGSLLCEV | 2594 |
| 1553 | CLLTEVGSLLCEV | 2168 |
| 496 | SCLTEVGSLLCEV | 1896 |
| 506 | SLCTEVGSLLCEV | 1863 |
| 1554 | SLLCEVGSLLCEV | 2399 |
| 1555 | SLLTCVGSLLCEV | 2264 |
| 477 | SLLTECGSLLCEV | 2403 |
| 1556 | CSCLCEVGSLLCEV | 1583 |
| 1557 | CLCTCVGSLLCEV | 2246 |
| 1558 | SCLCECGSLLCEV | 1747 |
| 814 | CSLLTECGSLLCEV | 2256 |
| 284 | ASLLTEVGSLLTCV | 2358 |
| 290 | CSLLTEVGSLLTCV | 2503 |
| 1559 | SLLCEVGSLLTCV | 1972 |
| 452 | SLLTEVGSLLTEC | 1862 |
| 292 | CSLLTEVGSLLTEC | 2213 |
| 351 | SLLCEVGSLLTEC | 2438 |
| 525 | SLLTEVGCSCLCEV | 1829 |
| 379 | SLCTEVGCSCLCEV | 1500 |
| 1560 | SLLCEVGCSCLCEV | 2112 |
| 299 | SLLTEVGCLCTCV | 2346 |
| 385 | CSLLTEVGCLCTCV | 2474 |
| 1561 | SLLCEVGCLCTCV | 2331 |
| 329 | SLLTEVGSCLCEC | 2558 |
| 533 | CSLLTEVGSCLCEC | 2625 |
| 1562 | SLLCEVGSCLCEC | 2614 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 353 | SLLTEVGCSLLTEC | 2380 |
| 747 | SLCTEVGCSLLTEC | 2050 |
| 301 | SLLCEVGCSLLTEC | 2637 |
| 341 | CSLLTEVCSLLTEC | 1122 |
| 321 | ALLTEVETPIRNEWGCRCNDSSD | 2225 |
| 1563 | DLLTEVETPIRNEWGCRCNDSSD | 2320 |
| 1564 | ELLTEVETPIRNEWGCRCNDSSD | 2201 |
| 1565 | FLLTEVETPIRNEWGCRCNDSSD | 1018 |
| 1566 | GLLTEVETPIRNEWGCRCNDSSD | 2321 |
| 1567 | HLLTEVETPIRNEWGCRCNDSSD | 1946 |
| 1568 | ILLTEVETPIRNEWGCRCNDSSD | 1044 |
| 1569 | KLLTEVETPIRNEWGCRCNDSSD | 1826 |
| 538 | LLLTEVETPIRNEWGCRCNDSSD | 1399 |
| 1570 | MLLTEVETPIRNEWGCRCNDSSD | 2126 |
| 1571 | NLLTEVETPIRNEWGCRCNDSSD | 2135 |
| 1572 | PLLTEVETPIRNEWGCRCNDSSD | 1641 |
| 1573 | QLLTEVETPIRNEWGCRCNDSSD | 1627 |
| 1574 | RLLTEVETPIRNEWGCRCNDSSD | 1338 |
| 326 | SLLTEVETPIRNEWGCRCNDSSD | 2476 |
| 312 | TLLTEVETPIRNEWGCRCNDSSD | 2510 |
| 520 | VLLTEVETPIRNEWGCRCNDSSD | 1758 |
| 1575 | WLLTEVETPIRNEWGCRCNDSSD | 2180 |
| 1576 | YLLTEVETPIRNEWGCRCNDSSD | 1882 |
| 349 | SLATEVETPIRNEWGCRCNDSSD | 2145 |
| 1577 | SLDTEVETPIRNEWGCRCNDSSD | 1505 |
| 328 | SLETEVETPIRNEWGCRCNDSSD | 1963 |
| 459 | SLITEVETPIRNEWGCRCNDSSD | 1996 |
| 377 | SLKTEVETPIRNEWGCRCNDSSD | 1453 |
| 327 | SLMTEVETPIRNEWGCRCNDSSD | 2149 |
| 449 | SLNTEVETPIRNEWGCRCNDSSD | 1908 |
| 352 | SLQTEVETPIRNEWGCRCNDSSD | 2025 |
| 510 | SLRTEVETPIRNEWGCRCNDSSD | 1034 |
| 473 | SLSTEVETPIRNEWGCRCNDSSD | 2052 |
| 478 | SLTTEVETPIRNEWGCRCNDSSD | 1804 |
| 484 | SLVTEVETPIRNEWGCRCNDSSD | 2029 |
| 1578 | SLLAEVETPIRNEWGCRCNDSSD | 2356 |
| 1579 | SLLDEVETPIRNEWGCRCNDSSD | 2276 |
| 1580 | SLLEEVETPIRNEWGCRCNDSSD | 2420 |
| 1581 | SLLFEVETPIRNEWGCRCNDSSD | 2137 |
| 1582 | SLLGEVETPIRNEWGCRCNDSSD | 2301 |
| 1583 | SLLHEVETPIRNEWGCRCNDSSD | 2462 |
| 1584 | SLLIEVETPIRNEWGCRCNDSSD | 1899 |
| 1585 | SLLKEVETPIRNEWGCRCNDSSD | 2611 |
| 1586 | SLLLEVETPIRNEWGCRCNDSSD | 2344 |
| 346 | SLLMEVETPIRNEWGCRCNDSSD | 2477 |
| 1587 | SLLNEVETPIRNEWGCRCNDSSD | 2425 |
| 381 | SLLQEVETPIRNEWGCRCNDSSD | 2432 |
| 1588 | SLLREVETPIRNEWGCRCNDSSD | 2286 |
| 803 | SLLSEVETPIRNEWGCRCNDSSD | 2305 |
| 1589 | SLLVEVETPIRNEWGCRCNDSSD | 1932 |
| 1590 | SLLWEVETPIRNEWGCRCNDSSD | 2221 |
| 1591 | SLLYEVETPIRNEWGCRCNDSSD | 2181 |
| 822 | SLLTDVETPIRNEWGCRCNDSSD | 1113 |
| 522 | SLLTMVETPIRNEWGCRCNDSSD | 1244 |
| 608 | SLLTEIETPIRNEWGCRCNDSSD | 2016 |
| 556 | SLLTELETPIRNEWGCRCNDSSD | 1380 |
| 547 | SLLTETETPIRNEWGCRCNDSSD | 1594 |
| 551 | SLLTEVATPIRNEWGCRCNDSSD | 2093 |
| 657 | SLLTEVDTPIRNEWGCRCNDSSD | 2095 |
| 731 | SLLTEVFTPIRNEWGCRCNDSSD | 1708 |
| 784 | SLLTEVGTPIRNEWGCRCNDSSD | 2005 |
| 690 | SLLTEVHTPIRNEWGCRCNDSSD | 2057 |
| 795 | SLLTEVITPIRNEWGCRCNDSSD | 1438 |
| 705 | SLLTEVKTPIRNEWGCRCNDSSD | 1905 |
| 709 | SLLTEVLTPIRNEWGCRCNDSSD | 1743 |
| 629 | SLLTEVMTPIRNEWGCRCNDSSD | 2331 |
| 675 | SLLTEVNTPIRNEWGCRCNDSSD | 2150 |
| 594 | SLLTEVQTPIRNEWGCRCNDSSD | 2289 |
| 575 | SLLTEVRTPIRNEWGCRCNDSSD | 1024 |
| 545 | SLLTEVSTPIRNEWGCRCNDSSD | 2288 |
| 553 | SLLTEVTTPIRNEWGCRCNDSSD | 2102 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 645 | SLLTEVVTPIRNEWGCRCNDSSD | 1492 |
| 583 | SLLTEVWTPIRNEWGCRCNDSSD | 1889 |
| 658 | SLLTEVYTPIRNEWGCRCNDSSD | 1092 |
| 635 | SLLTEVEAPIRNEWGCRCNDSSD | 2325 |
| 779 | SLLTEVEDPIRNEWGCRCNDSSD | 2216 |
| 652 | SLLTEVEEPIRNEWGCRCNDSSD | 2362 |
| 621 | SLLTEVEFPIRNEWGCRCNDSSD | 2297 |
| 646 | SLLTEVEGPIRNEWGCRCNDSSD | 2341 |
| 450 | SLLTEVEHPIRNEWGCRCNDSSD | 2241 |
| 593 | SLLTEVEIPIRNEWGCRCNDSSD | 2365 |
| 534 | SLLTEVEKPIRNEWGCRCNDSSD | 2505 |
| 564 | SLLTEVELPIRNEWGCRCNDSSD | 2407 |
| 590 | SLLTEVEMPIRNEWGCRCNDSSD | 2516 |
| 467 | SLLTEVENPIRNEWGCRCNDSSD | 2549 |
| 537 | SLLTEVEPPIRNEWGCRCNDSSD | 2522 |
| 527 | SLLTEVEQPIRNEWGCRCNDSSD | 2344 |
| 599 | SLLTEVERPIRNEWGCRCNDSSD | 2131 |
| 607 | SLLTEVESPIRNEWGCRCNDSSD | 2156 |
| 695 | SLLTEVEVPIRNEWGCRCNDSSD | 2286 |
| 763 | SLLTEVEWPIRNEWGCRCNDSSD | 2178 |
| 783 | SLLTEVEYPIRNEWGCRCNDSSD | 2113 |
| 559 | SLLTEVETAIRNEWGCRCNDSSD | 2415 |
| 610 | SLLTEVETDIRNEWGCRCNDSSD | 2392 |
| 602 | SLLTEVETEIRNEWGCRCNDSSD | 2368 |
| 549 | SLLTEVETFIRNEWGCRCNDSSD | 2301 |
| 597 | SLLTEVETGIRNEWGCRCNDSSD | 2366 |
| 609 | SLLTEVETHIRNEWGCRCNDSSD | 2288 |
| 653 | SLLTEVETIIRNEWGCRCNDSSD | 2096 |
| 300 | SLLTEVETKIRNEWGCRCNDSSD | 2485 |
| 491 | SLLTEVETLIRNEWGCRCNDSSD | 2225 |
| 493 | SLLTEVETMIRNEWGCRCNDSSD | 2320 |
| 529 | SLLTEVETNIRNEWGCRCNDSSD | 2253 |
| 606 | SLLTEVETQIRNEWGCRCNDSSD | 2189 |
| 611 | SLLTEVETRIRNEWGCRCNDSSD | 2159 |
| 700 | SLLTEVETSIRNEWGCRCNDSSD | 2151 |
| 649 | SLLTEVETTIRNEWGCRCNDSSD | 2295 |
| 614 | SLLTEVETVIRNEWGCRCNDSSD | 2264 |
| 670 | SLLTEVETWIRNEWGCRCNDSSD | 2146 |
| 581 | SLLTEVETYIRNEWGCRCNDSSD | 2290 |
| 715 | SLLTEVETPARNEWGCRCNDSSD | 2244 |
| 660 | SLLTEVETPDRNEWGCRCNDSSD | 2390 |
| 630 | SLLTEVETPERNEWGCRCNDSSD | 2480 |
| 665 | SLLTEVETPFRNEWGCRCNDSSD | 2229 |
| 495 | SLLTEVETPGRNEWGCRCNDSSD | 2676 |
| 591 | SLLTEVETPHRNEWGCRCNDSSD | 2425 |
| 392 | SLLTEVETPKRNEWGCRCNDSSD | 2300 |
| 461 | SLLTEVETPLRNEWGCRCNDSSD | 2239 |
| 457 | SLLTEVETPMRNEWGCRCNDSSD | 2297 |
| 770 | SLLTEVETPNRNEWGCRCNDSSD | 2299 |
| 738 | SLLTEVETPPRNEWGCRCNDSSD | 2302 |
| 782 | SLLTEVETPQRNEWGCRCNDSSD | 2341 |
| 750 | SLLTEVETPRRNEWGCRCNDSSD | 2376 |
| 673 | SLLTEVETPSRNEWGCRCNDSSD | 2396 |
| 758 | SLLTEVETPTRNEWGCRCNDSSD | 2417 |
| 650 | SLLTEVETPVRNEWGCRCNDSSD | 2331 |
| 693 | SLLTEVETPWRNEWGCRCNDSSD | 2190 |
| 389 | SLLTEVETPYRNEWGCRCNDSSD | 2303 |
| 707 | SLLTEVETPIANEWGCRCNDSSD | 2302 |
| 524 | SLLTEVETPIDNEWGCRCNDSSD | 2337 |
| 676 | SLLTEVETPIENEWGCRCNDSSD | 2252 |
| 576 | SLLTEVETPIFNEWGCRCNDSSD | 2176 |
| 744 | SLLTEVETPIGNEWGCRCNDSSD | 2073 |
| 488 | SLLTEVETPIHNEWGCRCNDSSD | 2121 |
| 720 | SLLTEVETPIINEWGCRCNDSSD | 2262 |
| 778 | SLLTEVETPIKNEWGCRCNDSSD | 2322 |
| 692 | SLLTEVETPILNEWGCRCNDSSD | 2363 |
| 454 | SLLTEVETPIMNEWGCRCNDSSD | 2369 |
| 780 | SLLTEVETPINNEWGCRCNDSSD | 2277 |
| 357 | SLLTEVETPIPNEWGCRCNDSSD | 2515 |
| 677 | SLLTEVETPIQNEWGCRCNDSSD | 2372 |
| 754 | SLLTEVETPISNEWGCRCNDSSD | 2292 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 766 | SLLTEVETPITNEWGCRCNDSSD | 2358 |
| 680 | SLLTEVETPIVNEWGCRCNDSSD | 2366 |
| 656 | SLLTEVETPIWNEWGCRCNDSSD | 2250 |
| 509 | SLLTEVETPIYNEWGCRCNDSSD | 2296 |
| 582 | SLLTEVETPIRAEWGCRCNDSSD | 2306 |
| 698 | SLLTEVETPIRDEWGCRCNDSSD | 2187 |
| 771 | SLLTEVETPIREEWGCRCNDSSD | 2156 |
| 620 | SLLTEVETPIRFEWGCRCNDSSD | 2364 |
| 773 | SLLTEVETPIRGEWGCRCNDSSD | 2228 |
| 721 | SLLTEVETPIRHEWGCRCNDSSD | 2296 |
| 627 | SLLTEVETPIRIEWGCRCNDSSD | 2444 |
| 631 | SLLTEVETPIRKEWGCRCNDSSD | 2437 |
| 585 | SLLTEVETPIRLEWGCRCNDSSD | 2468 |
| 622 | SLLTEVETPIRMEWGCRCNDSSD | 2385 |
| 753 | SLLTEVETPIRPEWGCRCNDSSD | 2301 |
| 661 | SLLTEVETPIRQEWGCRCNDSSD | 2367 |
| 710 | SLLTEVETPIRREWGCRCNDSSD | 2278 |
| 678 | SLLTEVETPIRSEWGCRCNDSSD | 2322 |
| 387 | SLLTEVETPIRTEWGCRCNDSSD | 2360 |
| 565 | SLLTEVETPIRVEWGCRCNDSSD | 2300 |
| 562 | SLLTEVETPIRWEWGCRCNDSSD | 2302 |
| 654 | SLLTEVETPIRYEWGCRCNDSSD | 2202 |
| 666 | SLLTEVETPIRNAWGCRCNDSSD | 2334 |
| 712 | SLLTEVETPIRNDWGCRCNDSSD | 2324 |
| 662 | SLLTEVETPIRNFWGCRCNDSSD | 2417 |
| 643 | SLLTEVETPIRNGWGCRCNDSSD | 2408 |
| 684 | SLLTEVETPIRNHWGCRCNDSSD | 2377 |
| 577 | SLLTEVETPIRNIWGCRCNDSSD | 2490 |
| 640 | SLLTEVETPIRNKWGCRCNDSSD | 2402 |
| 571 | SLLTEVETPIRNLWGCRCNDSSD | 2415 |
| 605 | SLLTEVETPIRNMWGCRCNDSSD | 2455 |
| 741 | SLLTEVETPIRNNWGCRCNDSSD | 2319 |
| 616 | SLLTEVETPIRNPWGCRCNDSSD | 2288 |
| 512 | SLLTEVETPIRNQWGCRCNDSSD | 2402 |
| 546 | SLLTEVETPIRNRWGCRCNDSSD | 2257 |
| 617 | SLLTEVETPIRNSWGCRCNDSSD | 2300 |
| 380 | SLLTEVETPIRNTWGCRCNDSSD | 2314 |
| 685 | SLLTEVETPIRNVWGCRCNDSSD | 2281 |
| 703 | SLLTEVETPIRNWWGCRCNDSSD | 2293 |
| 702 | SLLTEVETPIRNYWGCRCNDSSD | 2311 |
| 453 | SLLTEVETPIRNEAGCRCNDSSD | 2383 |
| 751 | SLLTEVETPIRNEDGCRCNDSSD | 2359 |
| 787 | SLLTEVETPIRNEEGCRCNDSSD | 2330 |
| 716 | SLLTEVETPIRNEFGCRCNDSSD | 2444 |
| 708 | SLLTEVETPIRNEGGCRCNDSSD | 2486 |
| 696 | SLLTEVETPIRNEHGCRCNDSSD | 2398 |
| 636 | SLLTEVETPIRNEIGCRCNDSSD | 2402 |
| 572 | SLLTEVETPIRNEKGCRCNDSSD | 2580 |
| 641 | SLLTEVETPIRNELGCRCNDSSD | 2436 |
| 517 | SLLTEVETPIRNEMGCRCNDSSD | 2398 |
| 637 | SLLTEVETPIRNENGCRCNDSSD | 2265 |
| 671 | SLLTEVETPIRNEPGCRCNDSSD | 2279 |
| 765 | SLLTEVETPIRNEQGCRCNDSSD | 2264 |
| 737 | SLLTEVETPIRNERGCRCNDSSD | 2328 |
| 745 | SLLTEVETPIRNESGCRCNDSSD | 2346 |
| 688 | SLLTEVETPIRNETGCRCNDSSD | 2401 |
| 386 | SLLTEVETPIRNEVGCRCNDSSD | 2411 |
| 384 | SLLTEVETPIRNEYGCRCNDSSD | 2426 |
| 681 | SLLTEVETPIRNEWACRCNDSSD | 2431 |
| 717 | SLLTEVETPIRNEWDCRCNDSSD | 2322 |
| 726 | SLLTEVETPIRNEWECRCNDSSD | 2364 |
| 596 | SLLTEVETPIRNEWFCRCNDSSD | 2493 |
| 633 | SLLTEVETPIRNEWHCRCNDSSD | 2327 |
| 347 | SLLTEVETPIRNEWICRCNDSSD | 2359 |
| 541 | SLLTEVETPIRNEWKCRCNDSSD | 2328 |
| 569 | SLLTEVETPIRNEWLCRCNDSSD | 2379 |
| 642 | SLLTEVETPIRNEWMCRCNDSSD | 2378 |
| 785 | SLLTEVETPIRNEWNCRCNDSSD | 2236 |
| 774 | SLLTEVETPIRNEWPCRCNDSSD | 2328 |
| 760 | SLLTEVETPIRNEWQCRCNDSSD | 2338 |
| 704 | SLLTEVETPIRNEWRCRCNDSSD | 2371 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 735 | SLLTEVETPIRNEWSCRCNDSSD | 2374 |
| 669 | SLLTEVETPIRNEWTCRCNDSSD | 2401 |
| 624 | SLLTEVETPIRNEWVCRCNDSSD | 2418 |
| 366 | SLLTEVETPIRNEWWCRCNDSSD | 2406 |
| 625 | SLLTEVETPIRNEWYCRCNDSSD | 2362 |
| 659 | SLLTEVETPIRNEWGARCNDSSD | 2396 |
| 790 | SLLTEVETPIRNEWGDRCNDSSD | 2267 |
| 370 | SLLTEVETPIRNEWGERCNDSSD | 2286 |
| 504 | SLLTEVETPIRNEWGFRCNDSSD | 2349 |
| 563 | SLLTEVETPIRNEWGGRCNDSSD | 2270 |
| 647 | SLLTEVETPIRNEWGHRCNDSSD | 2113 |
| 667 | SLLTEVETPIRNEWGIRCNDSSD | 2211 |
| 648 | SLLTEVETPIRNEWGKRCNDSSD | 2295 |
| 600 | SLLTEVETPIRNEWGLRCNDSSD | 2389 |
| 732 | SLLTEVETPIRNEWGMRCNDSSD | 2269 |
| 664 | SLLTEVETPIRNEWGNRCNDSSD | 2328 |
| 727 | SLLTEVETPIRNEWGPRCNDSSD | 2334 |
| 713 | SLLTEVETPIRNEWGQRCNDSSD | 2369 |
| 672 | SLLTEVETPIRNEWGRRCNDSSD | 2372 |
| 682 | SLLTEVETPIRNEWGSRCNDSSD | 2346 |
| 638 | SLLTEVETPIRNEWGTRCNDSSD | 2404 |
| 644 | SLLTEVETPIRNEWGVRCNDSSD | 2444 |
| 595 | SLLTEVETPIRNEWGWRCNDSSD | 2439 |
| 668 | SLLTEVETPIRNEWGYRCNDSSD | 2410 |
| 683 | SLLTEVETPIRNEWGCACNDSSD | 2301 |
| 501 | SLLTEVETPIRNEWGCCCNDSSD | 2515 |
| 615 | SLLTEVETPIRNEWGCDCNDSSD | 2207 |
| 679 | SLLTEVETPIRNEWGCECNDSSD | 2148 |
| 639 | SLLTEVETPIRNEWGCFCNDSSD | 2312 |
| 775 | SLLTEVETPIRNEWGCGCNDSSD | 2186 |
| 776 | SLLTEVETPIRNEWGCHCNDSSD | 2134 |
| 722 | SLLTEVETPIRNEWGCICNDSSD | 2269 |
| 701 | SLLTEVETPIRNEWGCKCNDSSD | 2290 |
| 748 | SLLTEVETPIRNEWGCLCNDSSD | 2292 |
| 730 | SLLTEVETPIRNEWGCMCNDSSD | 2413 |
| 743 | SLLTEVETPIRNEWGCNCNDSSD | 2340 |
| 767 | SLLTEVETPIRNEWGCPCNDSSD | 2295 |
| 756 | SLLTEVETPIRNEWGCQCNDSSD | 2294 |
| 736 | SLLTEVETPIRNEWGCSCNDSSD | 2348 |
| 719 | SLLTEVETPIRNEWGCTCNDSSD | 2347 |
| 742 | SLLTEVETPIRNEWGCVCNDSSD | 2334 |
| 503 | SLLTEVETPIRNEWGCWCNDSSD | 2437 |
| 552 | SLLTEVETPIRNEWGCYCNDSSD | 2397 |
| 634 | SLLTEVETPIRNEWGCRANDSSD | 2265 |
| 794 | SLLTEVETPIRNEWGCRDNDSSD | 2033 |
| 796 | SLLTEVETPIRNEWGCRENDSSD | 2097 |
| 723 | SLLTEVETPIRNEWGCRFNDSSD | 2303 |
| 752 | SLLTEVETPIRNEWGCRGNDSSD | 2345 |
| 734 | SLLTEVETPIRNEWGCRHNDSSD | 2353 |
| 697 | SLLTEVETPIRNEWGCRINDSSD | 2409 |
| 598 | SLLTEVETPIRNEWGCRKNDSSD | 2435 |
| 686 | SLLTEVETPIRNEWGCRLNDSSD | 2363 |
| 691 | SLLTEVETPIRNEWGCRMNDSSD | 2356 |
| 746 | SLLTEVETPIRNEWGCRNNDSSD | 2384 |
| 757 | SLLTEVETPIRNEWGCRPNDSSD | 2326 |
| 772 | SLLTEVETPIRNEWGCRQNDSSD | 2327 |
| 584 | SLLTEVETPIRNEWGCRRNDSSD | 2383 |
| 519 | SLLTEVETPIRNEWGCRSNDSSD | 2344 |
| 573 | SLLTEVETPIRNEWGCRTNDSSD | 2374 |
| 375 | SLLTEVETPIRNEWGCRVNDSSD | 2316 |
| 579 | SLLTEVETPIRNEWGCRWNDSSD | 2364 |
| 699 | SLLTEVETPIRNEWGCRYNDSSD | 2169 |
| 706 | SLLTEVETPIRNEWGCRCADSSD | 2329 |
| 728 | SLLTEVETPIRNEWGCRCCDSSD | 2377 |
| 762 | SLLTEVETPIRNEWGCRCDDSSD | 2289 |
| 739 | SLLTEVETPIRNEWGCRCEDSSD | 2273 |
| 560 | SLLTEVETPIRNEWGCRCFDSSD | 2538 |
| 689 | SLLTEVETPIRNEWGCRCGDSSD | 2343 |
| 651 | SLLTEVETPIRNEWGCRCHDSSD | 2350 |
| 612 | SLLTEVETPIRNEWGCRCIDSSD | 2450 |
| 318 | SLLTEVETPIRNEWGCRCKDSSD | 2549 |

TABLE 3-continued

Peptides that show specific binding to Z3G1 (A numeral "1" in the peptide sequence indicates a differentially protected cystein allowing for selective CLIP attachment at certain residues)

| SEQ ID NO: | Peptides that bind to Z3G1 | Signal |
|---|---|---|
| 618 | SLLTEVETPIRNEWGCRCLDSSD | 2480 |
| 628 | SLLTEVETPIRNEWGCRCMDSSD | 2470 |
| 516 | SLLTEVETPIRNEWGCRCPDSSD | 2449 |
| 568 | SLLTEVETPIRNEWGCRCQDSSD | 2438 |
| 544 | SLLTEVETPIRNEWGCRCRDSSD | 2447 |
| 729 | SLLTEVETPIRNEWGCRCSDSSD | 2141 |
| 674 | SLLTEVETPIRNEWGCRCTDSSD | 2253 |
| 632 | SLLTEVETPIRNEWGCRCVDSSD | 2366 |
| 555 | SLLTEVETPIRNEWGCRCWDSSD | 2462 |
| 626 | SLLTEVETPIRNEWGCRCYDSSD | 2385 |
| 619 | SLLTEVETPIRNEWGCRCNASSD | 2454 |
| 588 | SLLTEVETPIRNEWGCRCNCSSD | 2505 |
| 694 | SLLTEVETPIRNEWGCRCNESSD | 2282 |
| 535 | SLLTEVETPIRNEWGCRCNFSSD | 2509 |
| 603 | SLLTEVETPIRNEWGCRCNGSSD | 2418 |
| 613 | SLLTEVETPIRNEWGCRCNHSSD | 2439 |
| 586 | SLLTEVETPIRNEWGCRCNISSD | 2517 |
| 465 | SLLTEVETPIRNEWGCRCNKSSD | 2597 |
| 393 | SLLTEVETPIRNEWGCRCNLSSD | 2634 |
| 394 | SLLTEVETPIRNEWGCRCNMSSD | 2574 |
| 395 | SLLTEVETPIRNEWGCRCNNSSD | 2502 |
| 396 | SLLTEVETPIRNEWGCRCNPSSD | 2445 |
| 397 | SLLTEVETPIRNEWGCRCNQSSD | 2376 |
| 398 | SLLTEVETPIRNEWGCRCNRSSD | 2514 |
| 342 | SLLTEVETPIRNEWGCRCNSSSD | 2440 |
| 399 | SLLTEVETPIRNEWGCRCNTSSD | 2483 |
| 400 | SLLTEVETPIRNEWGCRCNVSSD | 2476 |
| 401 | SLLTEVETPIRNEWGCRCNWSSD | 2556 |
| 337 | SLLTEVETPIRNEWGCRCNYSSD | 2475 |
| 402 | SLLTEVETPIRNEWGCRCNDASD | 2267 |
| 403 | SLLTEVETPIRNEWGCRCNDCSD | 2318 |
| 404 | SLLTEVETPIRNEWGCRCNDDSD | 2237 |
| 405 | SLLTEVETPIRNEWGCRCNDESD | 2203 |
| 406 | SLLTEVETPIRNEWGCRCNDFSD | 2395 |
| 338 | SLLTEVETPIRNEWGCRCNDGSD | 2226 |
| 407 | SLLTEVETPIRNEWGCRCNDHSD | 2537 |
| 408 | SLLTEVETPIRNEWGCRCNDISD | 2527 |
| 409 | SLLTEVETPIRNEWGCRCNDKSD | 2484 |
| 410 | SLLTEVETPIRNEWGCRCNDLSD | 2494 |
| 411 | SLLTEVETPIRNEWGCRCNDMSD | 2405 |
| 412 | SLLTEVETPIRNEWGCRCNDNSD | 2389 |
| 413 | SLLTEVETPIRNEWGCRCNDPSD | 2450 |
| 414 | SLLTEVETPIRNEWGCRCNDQSD | 2349 |
| 415 | SLLTEVETPIRNEWGCRCNDRSD | 2502 |
| 416 | SLLTEVETPIRNEWGCRCNDTSD | 2394 |
| 417 | SLLTEVETPIRNEWGCRCNDVSD | 2389 |
| 418 | SLLTEVETPIRNEWGCRCNDWSD | 2491 |
| 330 | SLLTEVETPIRNEWGCRCNDYSD | 2445 |
| 419 | SLLTEVETPIRNEWGCRCNDSAD | 2219 |
| 420 | SLLTEVETPIRNEWGCRCNDSCD | 2269 |
| 356 | SLLTEVETPIRNEWGCRCNDSDD | 2181 |
| 421 | SLLTEVETPIRNEWGCRCNDSED | 2527 |
| 422 | SLLTEVETPIRNEWGCRCNDSFD | 2492 |
| 313 | SLLTEVETPIRNEWGCRCNDSGD | 2485 |
| 423 | SLLTEVETPIRNEWGCRCNDSHD | 2353 |
| 424 | SLLTEVETPIRNEWGCRCNDSID | 2320 |
| 425 | SLLTEVETPIRNEWGCRCNDSKD | 2361 |
| 426 | SLLTEVETPIRNEWGCRCNDSLD | 2400 |
| 427 | SLLTEVETPIRNEWGCRCNDSMD | 2304 |
| 350 | SLLTEVETPIRNEWGCRCNDSND | 2299 |
| 428 | SLLTEVETPIRNEWGCRCNDSPD | 2344 |
| 429 | SLLTEVETPIRNEWGCRCNDSQD | 2175 |
| 430 | SLLTEVETPIRNEWGCRCNDSRD | 2373 |
| 431 | SLLTEVETPIRNEWGCRCNDSTD | 2205 |
| 432 | SLLTEVETPIRNEWGCRCNDSVD | 2232 |
| 433 | SLLTEVETPIRNEWGCRCNDSWD | 2477 |
| 434 | SLLTEVETPIRNEWGCRCNDSYD | 2479 |
| 435 | SLLTEVETP | 2380 |
| 436 | SLLTEVETPI | 2465 |
| 437 | SLLTEVETPIR | 2297 |
| 438 | SLLTEVETPIRN | 2130 |

TABLE 3-continued

| Peptides that show specific binding to Z3G1 (A numeral "1" in the peptide sequence indicates a differentially protected cystein allowing for selective CLIP attachment at certain residues) | | |
|---|---|---|
| SEQ ID NO: | Peptides that bind to Z3G1 | Signal |
| 439 | SLLTEVETPIRNE | 1819 |
| 440 | SLLTEVETPIRNEW | 2334 |
| 368 | SLLTEVETPIRNEWG | 2429 |
| 442 | SLLTEVETPIRNEWGC | 2369 |
| 443 | SLLTEVETPIRNEWGCR | 2444 |
| 444 | SLLTEVETPIRNEWGCRC | 2478 |
| 445 | SLLTEVETPIRNEWGCRCN | 2506 |
| 446 | SLLTEVETPIRNEWGCRCND | 2276 |
| 447 | SLLTEVETPIRNEWGCRCNDS | 2348 |
| 448 | SLLTEVETPIRNEWGCRCNDSS | 2325 |

Further, the peptides were screened for the ability to specifically bind 23K21 and 8I10 and NOT Z3G. In one set, peptides with high binding values for 23K21 and 8I10 that are NOT recognized by Z3G1 were identified. In a second set, peptides with high binding values for Z3G1 that are NOT recognized by 23K21 and 8I10 were identified.

Peptide sequences with high binding values for 23K12 and BI10 with no binding to Z3G1 were identified for low stringency (0.01 μg/mL) conditions (Table 4A) and high stringency (0.001 μg/mL) conditions (Table 4B).

TABLE 4A

| | |
|---|---|
| MCLCTCVGCSLLTEC | SEQ ID NO: 315 |
| CLCTCVGCSLLTEC | SEQ ID NO: 819 |
| SLLTECGCSCLCEV | SEQ ID NO: 567 |
| MSCLCECGCSLLTEC | SEQ ID NO: 340 |
| SLLTECGCSLLTEC | SEQ ID NO: 374 |
| CSLLTECGCSLLTEC | SEQ ID NO: 483 |
| SLLTECGSCLCEC | SEQ ID NO: 497 |
| MSLLTECGCSLLTEC | SEQ ID NO: 818 |
| CSCLCEVGCSLLTEC | SEQ ID NO: 335 |
| SLLTECGSCLTEV | SEQ ID NO: 601 |
| CLCTCVGSLLTEC | SEQ ID NO: 455 |
| SCLTEVGSLLTEC | SEQ ID NO: 823 |
| CSLLTECGSCLCEC | SEQ ID NO: 815 |
| CSLLTECGMSCLCEC | SEQ ID NO: 558 |
| MSLLTCVGCSLLTEC | SEQ ID NO: 820 |
| CSLLTECGSLLTEC | SEQ ID NO: 813 |
| SCLTEVGCSLLTEC | SEQ ID NO: 808 |
| SCLCECGCSLLTEC | SEQ ID NO: 361 |
| MSCLTEVGCSLLTEC | SEQ ID NO: 799 |
| CSLLTECGCSCLCEV | SEQ ID NO: 817 |
| CSCLCEVGMSLLTEC | SEQ ID NO: 305 |
| SLLTECGCLLTEV | SEQ ID NO: 462 |

TABLE 4B

| | |
|---|---|
| CSLLTECG-SLLTCV | SEQ ID NO: 1592 |
| CSLLTECGMSLLTCV | SEQ ID NO: 306 |
| SLLTECG-SLLTCV | SEQ ID NO: 1593 |
| MSLLTECGMCLLTEV | SEQ ID NO: 489 |
| MSLLTECGMSLLTCV | SEQ ID NO: 331 |
| SLLTECGCSLLTEC | SEQ ID NO: 374 |

Properties of the peptides that bind specifically to HuM2e antibodies 23K12/BI10 at different stringency conditions were analyzed. Antibodies 8i10 and 23k12 bind a conformational epitope with SLLTE as its core sequence. The best 23k12 binder is SLLTEVGSLLTEV (SEQ ID NO: 320), which is also recognized by Z3G1. The best 8i10 binder is CSLLTEVGSLLTEV (SEQ ID NO: 283), which is also recognized by Z3G1. The very best specific binder is CSLLTECGSLLTCV (SEQ ID NO: 463). The binding sequences contain a remarkably high number of cysteines.

Peptide sequences with high binding values for Z3G1 with no binding to 23K12 and BI10 were identified for low stringency (0.01 μg/mL) conditions (Table 5A) and high stringency (0.001 μg/mL) conditions (Table 5B).

TABLE 5A

| High binding values with Z3G1 NO binding 23k12 & 8i10, ■ | |
|---|---|
| CSLLCEVETPIRNE | SEQ ID NO: 1316 |
| CLL■EVECPIRNE | SEQ ID NO: 1358 |
| SLLCEVETPIRNE | SEQ ID NO: 1371 |
| CMSLLCEVETPIRNE | SEQ ID NO: 1313 |
| SLLCEVETPIRNCWG | SEQ ID NO: 1389 |
| SLLCEVETPICNEWG | SEQ ID NO: 1391 |
| MSLLLEVETPIRNEWGCRCN | SEQ ID NO: 1287 |
| CSLLCEVETPIRNE | SEQ ID NO: 1316 |
| MRLLTEVETPIRNEWGCRCN | SEQ ID NO: 1263 |
| SLLCEVETPIRCEWG | SEQ ID NO: 1390 |
| CLLTEVETPCRNEWG | SEQ ID NO: 1381 |
| SLLCEVETPIRNEWC | SEQ ID NO: 1387 |
| MSLLCEVGMSLLCEV | SEQ ID NO: 1341 |

TABLE 5B

| High binding values with Z3G1 NO binding 23k12 & 8i10, ■ | |
|---|---|
| MSLLTEVDTPIRNEWGCRCN | SEQ ID NO: 1300 |
| MSLLMEVETPIRNEWGCRCN | SEQ ID NO: 1288 |
| MSLLEEVETPIRNEWGCRCN | SEQ ID NO: 1281 |
| MSLLCEVETPIRNC | SEQ ID NO: 1325 |
| MSLLSEVETPIRNEWGCRCN | SEQ ID NO: 1293 |
| MSLLNEVETPIRNEWGCRCN | SEQ ID NO: 1289 |
| MSLLKEVETPIRNEWGCRCN | SEQ ID NO: 1286 |
| SLLCEVECPIRNEWG | SEQ ID NO: 1394 |
| MSLLAEVETPIRNEWGCRCN | SEQ ID NO: 1279 |
| MSLLDEVETPIRNEWGCRCN | SEQ ID NO: 1280 |
| MDLLTEVETPIRNEWGCRCN | SEQ ID NO: 1251 |
| MNLLTEVETPIRNEWGCRCN | SEQ ID NO: 1260 |
| Now dominant Motif occurs! | |

There is a clear difference between binding specificity between antibodies 8i10/23k12 versus Z3G1. The very best specific binder is a longer sequence than with 23k12/8i10, has no dimer topology and also no CLIPS. Among the very best specific binder is mostly the whole native sequence, MSLLTEVETPIRNEWGCRCN (SEQ ID NO: 1149). The result with 0.01 μg/ml shows that LLXEVEXPIRN (SEQ ID NO: 1594) is the core of the Z3G1 binding epitope.

Specific binding motifs can derived from 0.001 μg/ml screening. Thus, mAbs 23k12/8i10 recognize M2e peptides with SLLTE as the core of the epitope. The T residue in S-L-L-T-E differentiates binding between 23k12/8i10 and Z3G1. In contrast, mAb Z3G1 recognize M2e with LLX-EVEXPIRN (SEQ ID NO: 1594) as the core of the epitope. (Tables 6A and 6B).

TABLE 6A

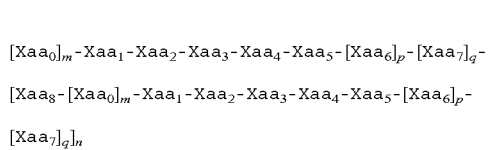

| | |
|---|---|
| CSLL ECG-SLL CV | SEQ ID NO: 1595 |
| CSLL ECGMSLL CV | SEQ ID NO: 306 |
| SLL ECG-SLL CV | SEQ ID NO: 1596 |
| MSLL ECGMCLL EV | SEQ ID NO: 489 |
| MSLL ECGMSLL CV | SEQ ID NO: 331 |
| SLL ECGCSLL EV | SEQ ID NO: 374 |

TABLE 6B 0,001 ug/ml

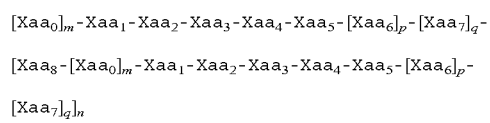

| | |
|---|---|
| MSLLTEVDTPIRNEWGCRCN | SEQ ID NO: 1300 |
| MSLLMEVETPIRNEWGCRCN | SEQ ID NO: 1288 |
| MSLLEEVETPIRNEWGCRCN | SEQ ID NO: 1281 |
| MSLLCEVETPIRNC | SEQ ID NO: 1325 |
| MSLLSEVETPIRNEWGCRCN | SEQ ID NO: 1293 |
| MSLLNEVETPIRNEWGCRCN | SEQ ID NO: 1289 |
| MSLLKEVETPIRNEWGCRCN | SEQ ID NO: 1286 |
| SLLCEVECPIRNEWG | SEQ ID NO: 1394 |
| MSLLAEVETPIRNEWGCRCN | SEQ ID NO: 1279 |
| MSLLDEVETPIRNEWGCRCN | SEQ ID NO: 1280 |
| MDLLTEVETPIRNEWGCRCN | SEQ ID NO: 1251 |
| MNLLTEVETPIRNEWGCRCN | SEQ ID NO: 1260 |

Peptide Immunogens

In particular, a peptide immunogen of this invention that binds the HuM2e 23k12/8i10 comprises a core sequence of S-L-L-T-E as well as variants, modifications and multimers thereof. Core sequences for low stringency (0.01 μg/mL) conditions (FIG. 6A) and high stringency (0.001 μg/mL) conditions (FIG. 6B) and variants thereof derived from the binding data are shown in FIGS. 6A and 6B.

In some embodiments, the core sequence comprises a first additional amino acid at the C terminal end of S-L-L-T-E-$Xaa_6$, wherein $Xaa_6$ is any amino acid, preferably V or C. (FIG. 6C)

Further, in some embodiments, the core sequence comprises a first additional amino acid at the C terminal end of S-L-L-T-E-$Xaa_6$-$Xaa_7$, wherein $Xaa_7$ is any amino acid, but preferably E. (FIG. 6C)

In some embodiments, the peptide immunogens comprise a plurality of core sequences linked by an amino acid, preferably a small amino acid such as G or A. However, amino acids such as proline, which can act as a structural disrupter in the middle of regular secondary structure elements such as alpha helices and beta sheets, are less desirable. The number of core sequences in peptide immunogens of the invention can be 1, 2, 3, 4, 5 or more. (FIG. 6D).

In some embodiments, an N-terminal amino acid $Xaa_0$ is present in the peptide immunogens. $Xaa_0$ can be any amino acid, but preferably is a cysteine. In some embodiments a N-terminal cysteine is used to cyclize the peptide immunogen. (FIG. 6E)

Peptide immunogens (linear or cyclized) with particularly strong affinity for 23K12/8I10 binding are shown in FIG. 6F.

The peptide immunogens of this invention that bind the huM2e monoclonal antibodies under high stringency conditions are represented by the following formula:

$[Xaa_0]_m$-$Xaa_1$-$Xaa_2$-$Xaa_3$-$Xaa_4$-$Xaa_5$-$[Xaa_6]_p$-$[Xaa_7]_q$-

$[Xaa_8$-$[Xaa_0]_m$-$Xaa_1$-$Xaa_2$-$Xaa_3$-$Xaa_4$-$Xaa_5$-$[Xaa_6]_p$-

$[Xaa_7]_q]_n$ wherein, m, p and q are independently 0 or 1,
n is any number between 0 and 4,
$Xaa_0$ is any amino acid, preferably C;
$Xaa_6$ is any amino acid, preferably V or C;
$Xaa_7$ is any amino acid, preferably E;
$Xaa_8$ is any amino acid not including proline, preferably G or A;
$Xaa_1$-$Xaa_2$-$Xaa_3$-$Xaa_4$-$Xaa_5$ is S-L-L-T-E,
or a peptide having a single substitution to the sequence S-L-L-T-E, the substitution selected from the group consisting of:
$Xaa_1$ is C or T;
$Xaa_2$ is A, C, F or K,
$Xaa_3$ is A, C, E, F, I, K, M, Q, S, T or V, and
$Xaa_5$ is D or C.

The peptide immunogens of this invention that bind the huM2e monoclonal antibodies under low stringency conditions are represented by the following formula:

$[Xaa_0]_m$-$Xaa_1$-$Xaa_2$-$Xaa_3$-$Xaa_4$-$Xaa_5$-$[Xaa_6]_p$-$[Xaa_7]_q$-

$[Xaa_8$-$[Xaa_0]_m$-$ general methodology of solid phase synthesis is well known in the art. Merrifield, R. B., Solid phase synthesis (Nobel lecture). Angew Chem 24:799-810 (1985) and Barany et al., The Peptides, Analysis, Synthesis and Biology, Vol. 2, Gross, E. and Meienhofer, J., Eds. Academic Press 1-284 (1980). For example, chemical reaction protocols, such as those described in U.S. Pat. Nos. 4,033,940 and 4,102,877, have been devised to produce circularized peptides. In other techniques, biological and chemical methods are combined to produce cyclic peptides. These latter methods involve first expressing linear precursors of cyclic peptides in cells (e.g., bacteria) to produce linear precursors of cyclic peptides and then adding of an exogenous agent such as a protease or a nucleophilic reagent to chemically convert these linear precursors into cyclic peptides. See, e.g., Camerero, J. A., and Muir, T. W., J. Am. Chem. Society. 121:5597 (1999); Wu, H. et al, Proc. Natl. Acad. Sci. USA, 95:9226 (1998).

Head-to-tail (backbone) peptide cyclization has been used to rigidify structure and improve in vivo stability of small bioactive peptides (see Camarero and Muir, J. Am. Chem. Soc., 121:5597-5598 (1999)). An important consequence of peptide cyclization is retention of biological activity and/or the identification of new classes of pharmacological agents. A chemical cross-linking approach was used to prepare a backbone cyclized version of bovine pancreatic trypsin inhibitor (Goldenburg and Creighton, J. Mol. Biol., 165:407-413 (1983)). Other approaches include chemical (Camarero et al., Angew. Chem. Int. Ed., 37:347-349 (1998); Tam and Lu, Prot. Sci., 7:1583-1592 (1998); Camarero and Muir, Chem. Commun., 1997:1369-1370 (1997); and Zhang and Tam, J. Am. Chem. Soc. 119:2363-2370 (1997)) and enzymatic (Jackson et al., J. Am. Chem. Soc., 117:819-820 (1995)) intramolecular ligation methods which allow linear synthetic peptides to be efficiently cyclized under aqueous conditions.

A native chemical ligation approach utilizes inteins (internal proteins) to catalyze head-to-tail peptide and protein ligation in vivo (see, for example, Evans et al., J. Biol. Chem. 274:18359-18363 (1999); Iwai and Pluckthun, FEBS Lett. 459.166-172 (1999); Wood et al., Nature Biotechnology 17:889-892 (1999); Camarero and Muir, J. Am. Chem. Soc. 121:5597-5598 (1999); and Scott et al., Proc. Natl. Acad. Sci. USA 96:13638-13643 (1999)).

The invention also encompasses isolated nucleic acid molecules comprising a sequences that encode M2e peptide immunogens of the invention. Also provided by the present invention are nucleic acid expression constructs, and host cells containing such nucleic acids, which encode M2e peptides, and variants thereof, which have at least one epitope characteristic of M2e peptide immunogens. This aspect of the invention pertains to isolated nucleic sequences encoding an M2e sequence or M2e peptide immunogen sequence as described herein, as well as those sequences readily derived from isolated nucleic molecules such as, for example, complementary sequences, reverse sequences and complements of reverse of sequences.

A related embodiment includes a nucleic acid expression construct comprising a promoter operably linked to the isolated nucleic acid molecule such that a M2e peptide immunogen or fusion protein comprising a M2e peptide immunogen as described herein is expressed in a host cell. In another embodiment, the invention provides a host cell containing such a nucleic acid expression construct. In a related embodiment, the invention provides a method for producing a peptide immunogen, comprising growing the described host cells for a time sufficient to express the peptide immunogen encoded by the nucleic acid expression construct.

Conjugated Peptide Immunogens

The approach of increasing immunogenicity of small immunogenic molecules by conjugating these molecules to large "carrier" molecules has been utilized successfully for decades (see, e.g., Goebel et al. (1939) J. Exp. Med. 69: 53). For example, many immunogenic compositions have been described in which purified capsular polymers have been conjugated to carrier proteins to create more effective immunogenic compositions by exploiting this "carrier effect." Schneerson et al. (1984) Infect. Immun. 45: 582-591).

In one aspect of the invention, method for conjugating a M2e peptide immunogen via a reactive group of an amino acid residue of the peptide immunogen to a protein/polypeptide carrier having one or more functional groups is provided. The protein/polypeptide carrier may be human serum albumin, keyhole limpet hemocyanin (KLH), immunoglobulin molecules, thyroglobulin, ovalbumin, influenza hemagglutinin, PAN-DR binding peptide (PADRE polypeptide), malaria circumsporozite (CS) protein, hepatitis B surface antigen ($HBSAg_{19-28}$), Heat Shock Protein (HSP) 65, *Bacillus* Calmette-Guerin (BCG), cholera toxin, cholera toxin mutants with reduced toxicity, diphtheria toxin, $CRM_{197}$ protein that is cross-reactive with diphtheria toxin, recombinant Streptococcal C5a peptidase, *Streptococcus pyogenes* ORF1224, *Streptococcus pyogenes* ORF1664, *Streptococcus pyogenes* ORF 2452, *Chlamydia pneumoniae* ORF T367, *Chlamydia pneumoniae* ORF T858, Tetanus toxoid, HIV gp120 T1, microbial surface components recognizing adhesive matrix molecules (MSCRAMMS), growth factor/hormone, cytokines or chemokines.

Methods for protecting a subject from infection or decreasing susceptibility of a subject to infection by one or more influenza strains/isolates or subtypes, i.e., prophylactic methods, are additionally provided. In one embodiment, a method includes administering to the subject an amount of M2e peptide immunogens that specifically bind influenza M2 effective to protect the subject from infection, or effective to decrease susceptibility of the subject to infection, by one or more influenza strains/isolates or subtypes.

Symptoms or complications of influenza infection that can be reduced or decreased include, for example, chills, fever, cough, sore throat, nasal congestion, sinus congestion, nasal infection, sinus infection, body ache, head ache, fatigue, pneumonia, bronchitis, ear infection, ear ache or death.

Peptide Immunogens as Vaccines

The peptide immunogens can be used as vaccines to generate an anti-influenza M2-mediated immune response in order to prevent influenza infections. Synthetic peptides require both stabilization and adjuvantation for the induction of an effective immune response in vivo. Various methods have been employed to protect synthetic peptide immunogens against degradation in vitro and in vivo, mediated by various processes including chemical and physical pathways. (Manning M C, et al. Pharmaceutical Research, 1989, 6:903-918).

Numerous adjuvants and/or depot-based parenteral, mucosal or transdermal delivery systems destined for use with human or veterinary vaccines have been developed to enhance the immune response. These include the use of mineral salts, water-in-oil (w/o)-emulsions, liposomes, polymeric microparticles, nanoparticles and gels/hydrogels. (Cox J C, et al. Vaccine, 1997, 15:248-256). Freund's complete adjuvant (FCA), a suspension of heat-killed *M. tuberculosis* mycobacteria in mineral oil containing a surfactant, has been recognized as one of the most powerful adjuvants. Adjuvants are well known in the art (Vaccine Design—The Subunit and Adjuvant Approach, 1995, Pharmaceutical Biotechnology, Volume 6, Eds. Powell, M. F., and Newman, M. J., Plenum Press, New York and London, ISBN 0-306-44867-X). Preferred adjuvants for use with immunogens of the present invention include aluminium or calcium salts (hydroxide or phosphate). Adjuvants may be selected from GM-CSF, 529 SE, IL-12, aluminum phosphate, aluminum hydroxide, *Mycobacterium tuberculosis, Bordetella pertussis*, bacterial lipopolysaccharides, aminoalkyl glucosane phosphate compounds, MPL™ (3-O-deacylated monophosphoryl lipid A), a polypeptide, Quil A, STIMULON™ QS-21, a pertussis toxin (PT), an *E. coli* heat-labile toxin (LT), IL-1alpha, IL-1β, IL-2, IL-4, IL-5, IL-6, IL-7, IL-8, IL-10, IL-13, IL-14, IL-15, IL-16, IL-17, IL-18, interferon-alpha, interferon-β, interferon-gamma, G-CSF, TNF-alpha and TNF-β.

Still other adjuvants include mineral oil and water emulsions, calcium salts such as calcium phosphate, aluminum salts (alum), such as aluminum hydroxide, aluminum phosphate, etc., Amphigen, Avridine, L121/squalene, D-lactide-polylactide/glycoside, pluronic acids, polyols, muramyl dipeptide, killed *Bordetella*, saponins, such as Stimulon™ QS-21 (Antigenics, Framingham, Mass.), described in U.S. Pat. No. 5,057,540, which is hereby incorporated by reference 3, and particles generated therefrom such as ISCOMS (immunostimulating complexes), *Mycobacterium tuberculosis*, bacterial lipopolysaccharides, synthetic polynucleotides such as oligonucleotides containing a CpG motif (U.S. Pat. No. 6,207,646, which is hereby incorporated by reference), a pertussis toxin (PT), or an *E. coli* heat-labile toxin (LT), particularly LT-K63, LT-R72, PT-K9/G129; see, e.g., International Patent Publication Nos. WO 93/13302 and WO 92/19265, which are/incorporated herein by reference for all purposes.

Also useful as adjuvants are cholera toxins and mutants thereof, including those described in published International Patent Application No. WO 00/18434 (wherein the glutamic acid at amino acid position 29 is replaced by another amino acid (other than aspartic acid, preferably a histidine). Similar CT toxins or mutants are described in published International Patent Application number WO 02/098368 (wherein the isoleucine at amino acid position 16 is replaced by another amino acid, either alone or in combination with the replacement of the serine at amino acid position 68 by another amino acid; and/or wherein the valine at amino acid position 72 is replaced by another amino acid). Other CT toxins are described in published International Patent Application number WO 02/098369 (wherein the arginine at amino acid position 25 is replaced by another amino acid; and/or an amino acid is inserted at amino acid position 49; and/or two amino acids are inserted at amino acid position 35 and 36).

Various methods may be employed to adjuvant synthetic peptide-based immunogens, but normally a carrier or depot system is required for effective long-term immunogenic responses. Notable examples include adsorbing the immunogen onto a mineral salt or gel. For example, encapsulating a peptide immunogen within a polymeric matrix (monolithic matrix) or gel, or layering a polymeric material around a peptide immunogen (core-shell) may be an effective strategy. Or, an immunogen may be incorporated in a liposome or vesicular type of formulation, with the immunogen either embedded in the lipid matrix or physically entrapped in the internal aqueous phase. Another strategy may employ a mineral-based, vegetable-based or animal-based oil, with an aqueous solution of the immunogen in various proportions, to prepare a water-in-oil (w/o)-emulsion or a water-in-oil-in-water (w/o/w)-double emulsion. Powell M F, et al., Pharmaceutical Biotechnology, Vol. 6, Plenum Press, New York, 1995.

Kits

It is particularly useful to use antibody binding sequences in the kit, which correspond to defined epitope sequences known to be specific for the immunogen under investigation. This kit will lead to a more specific answer than those kits used today, and hence to a better selection of immunogen vaccine therapy for the individual patient.

In an extension of this approach, one could also characterize the patient's serum by identifying the corresponding antibody binding peptides among a random display library using the aforementioned methods. This again may lead to optimisation of the epitope information, and thus to a better diagnosis.

Further, one could use the individual antibody binding sequences as (immunogen) vaccines leading to more specific (immunogen) vaccines. These antibody binding sequences could be administered in an isolated form or fused to a membrane protein of the phage display system, or to another carrier protein, which may have beneficial effect for the immunoprotective effect of the antibody binding peptide (Dalum et al., Nature Biotechnology, Vol. 17, pp. 666-669 (1999)).

The present invention relates to a kit for predicting binding of a specific antibody to at least one potential immunogen. The kit of the invention would also be useful for other screening purposes where it is desirable to test for antibody binding to peptide sequences, such as epitope variant.

In one embodiment the peptide immunogen may be immobilized on a solid support. Suitable solid support could be any chemical support, including micro titer plates, beads, capillary tubing or membranes. Each of these supports could be activated, supporting covalent, ionic or hydrophobic binding, chelation or affinity binding, or inactivated, promoting ionic or hydrophobic binding. Immobilisation could take place by attachment through covalent binding, ionic or hydrophobic binding, chelation, affinity binding, or through van der Waal bonds. A solid support could also be biological in nature, such as phages, bacteria, red blood cells or any related system allowing display of heterologous proteins or peptides.

The kit also can be used for screening different antigenic peptide sequences corresponding to structural epitopes at the same time. The kit above also can be used in a high throughput screening method for screening many samples, obtained e.g. from humans or animals, at the same time and thereby predicting which humans or animals will display an immunogenic response towards particular immunogens. Any practical combination of the number of antigenic peptide sequences and the number of humans or animals would be possible.

The following examples illustrate embodiments of the invention. It will be appreciated by one of skill in the art that the techniques disclosed in the examples which follow represent techniques discovered by the inventors to function well in the practice of the invention. However, those of skill in the art should, in light of the present disclosure, appreciate that many changes can be made in the specific embodiments which are disclosed and still obtain a like or similar result without departing from the spirit and scope of the invention.

EXAMPLES

Example 1

Identification of M2-Specific Antibodies

Mononuclear or B cells expressing three of the MAbs identified in human serum were diluted into clonal populations and induced to produce antibodies. Antibody containing supernatants were screened for binding to 293 FT cells stably transfected with the full length M2E protein from influenza strain Influenza subtype H3N2. Supernatants which showed positive staining/binding were re-screened again on 293 FT cells stably transfected with the full length M2E protein from influenza strain Influenza subtype H3N2 and on vector alone transfected cells as a control.

The variable regions of the antibodies were then rescue cloned from the B cell wells whose supernatants showed positive binding. Transient transfections were performed in 293 FT cells to reconstitute and produce these antibodies. Reconstituted antibody supernatants were screened for binding to 293 FT cells stably transfected with the full length M2E protein as detailed above to identify the rescued anti-M2E antibodies. Three different antibodies were identified: 8i10, 21B15 and 23K12.

Antibodies 21B15, 23K12, and 8I10 bound to the surface of 293-HEK cells stably expressing the M2 protein, but not to vector transfected cells (see FIG. 1). In addition, binding of these antibodies was not competed by the presence of 5 mg/ml 24-mer M2 peptide, whereas the binding of the control chimeric mouse V-region/human IgG1 kappa 14C2 antibody (hu14C2) generated against the linear M2 peptide was completely inhibited by the M2 peptide (see FIG. 1). These data confirm that these antibodies bind to conformational epitopes present in M2e expressed on the cell or virus surface, as opposed to the linear M2e peptide.

Example 2

Viral Binding of Human Anti-influenza Monoclonal Antibodies

Figure 2A:
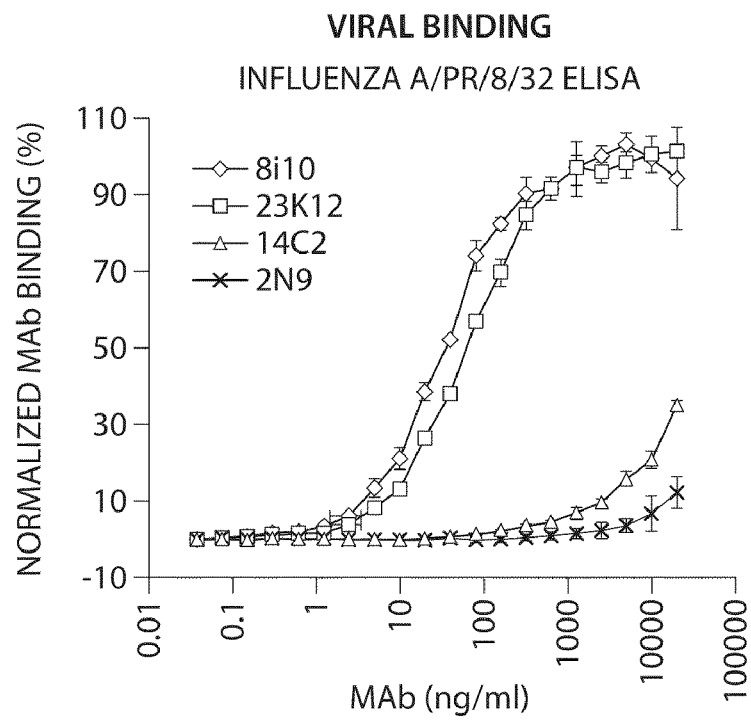
FIGS. 2A and 2B are graphs showing human monoclonal antibody binding to influenza A/PR/32.
Figure 2B:
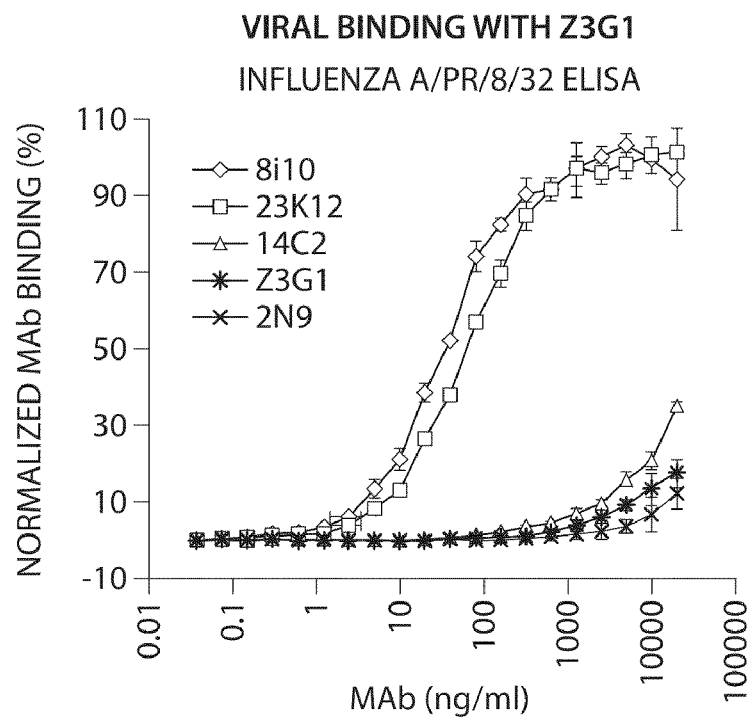

UV-inactivated influenza A virus (A/PR/8/34) (Applied Biotechnologies) was plated in 384-well MaxiSorp plates (Nunc) at 1.2 µg/ml in PBS, with 25 µl/well, and was incubated at 4° C. overnight. The plates were then washed three times with PBS, and blocked with 1% Nonfat dry milk in PBS, 50 µl/well, and then were incubated at room temp for 1 hr. After a second wash with PBS, MAbs were added at the indicated concentrations in triplicate, and the plates were incubated at room temp for 1 hour. After another wash with PBS, to each well was added 25 µl of a 1/5000 dilution of horseradish peroxidase (HRP) conjugated goat anti-human IgG Fc (Pierce) in PBS/1% Milk, and the plates were left at room temp for 1 hr. After the final PBS wash, the HRP substrate 1-Step™ Ultra-TMB-ELISA (Pierce) was added at 25 µl/well, and the reaction proceeded in the dark at room temp. The assay was stopped with 25 µl/well 1N $H_2SO_4$, and light absorbance at 450 nm (A450) was read on a SpectroMax Plus plate reader. Data are normalized to the absorbance of MAb 8I10 binding at 10 µ/ml. Results are shown in FIGS. 2A and 2B.

Example 3

Binding of Human Anti-Influenza Monoclonal Antibodies to Full-Length M2 Variants M2 variants (including those with a high pathology phenotype in vivo) were selected for analysis. See FIG. 3A for sequences.

Figure 3B:
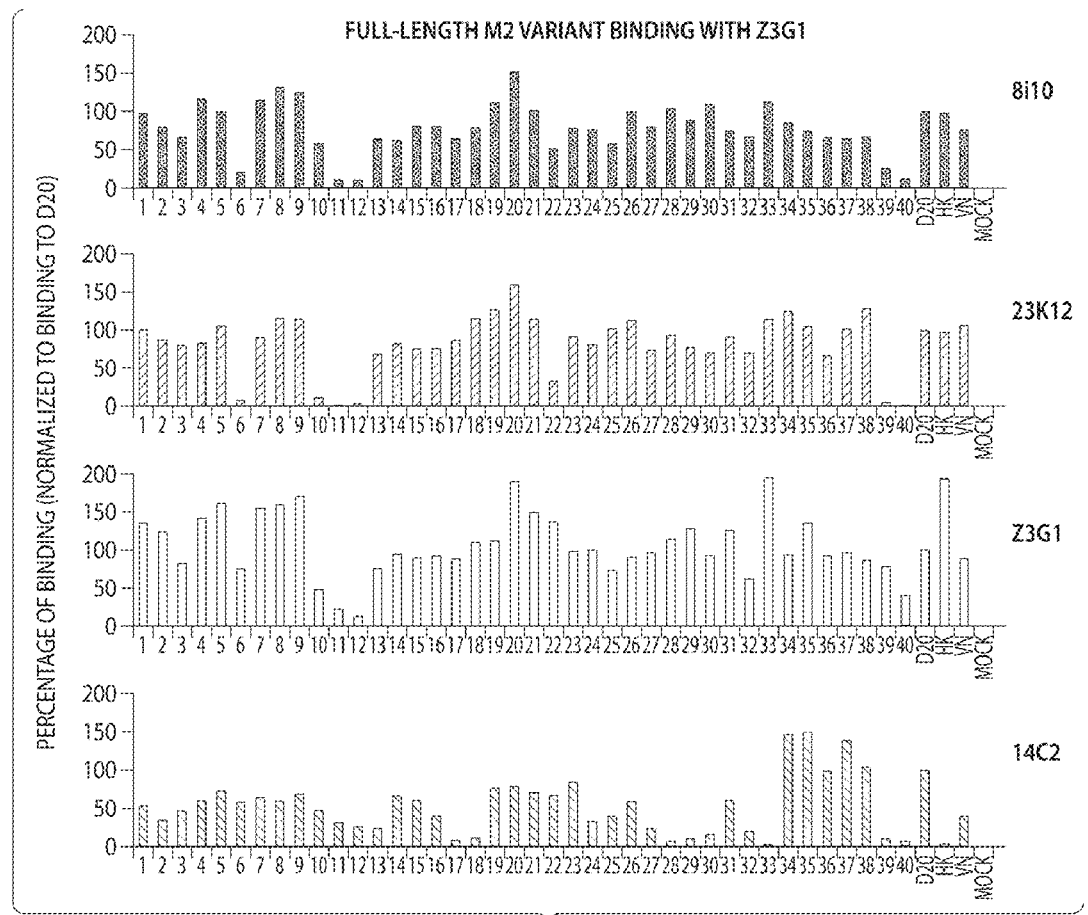
FIGS. 3B and 3C are bar charts showing binding of human monoclonal anti-influenza antibody binding to M2 variants shown in FIG. 3A.
Figure 3C:
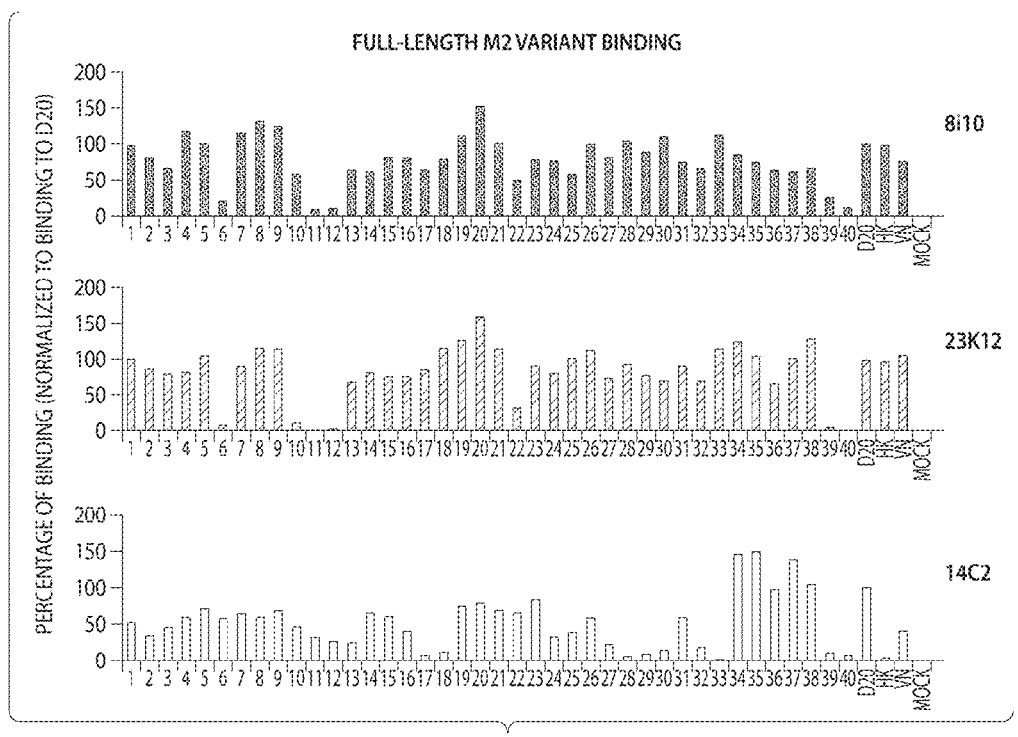

M2 cDNA constructs were transiently transfected in HEK293 cells and analyzed as follows: To analyze the transient transfectants by FACS, cells on 10 cm tissue culture plates were treated with 0.5 ml Cell Dissociation Buffer (Invitrogen), and harvested. Cells were washed in PBS containing 1% FBS, 0.2% $NaN_3$ (FACS buffer), and resuspended in 0.6 ml FACS buffer supplemented with 100 µg/ml rabbit IgG. Each transfectant was mixed with the indicated MAbs at 1 µg/ml in 0.2 ml FACS buffer, with $5 \times 10^5$ to $10^6$ cells per sample. Cells were washed three times with FACS buffer, and each sample was resuspended in 0.1 ml containing 1 µg/ml alexafluor (AF) 647-anti human IgG H&L (Invitrogen). Cells were again washed and flow cytometry was performed on a FACSCanto device (Becton-Dickenson). The data is expressed as a percentage of the mean fluorescence of the M2-D20 transient transfectant. Data for variant binding are representative of 2 experiments. Data for alanine mutants are average readouts from 3 separate experiments with standard error. Results are shown in FIGS. 3B and 3C.

Example 4

Epitope Blocking

Figure 4:
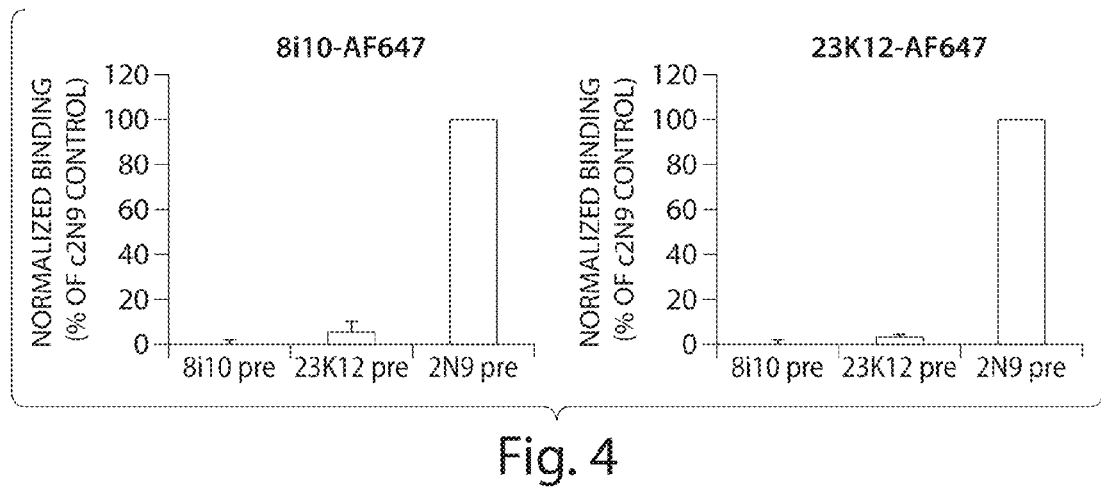
FIG. 4 is a series of bar charts showing binding of MAbs 8I10 and 23K12 to M2 protein representing influenza strain A/HK/483/1997 sequence that was stably expressed in the CHO cell line DG44.
Figure 5:
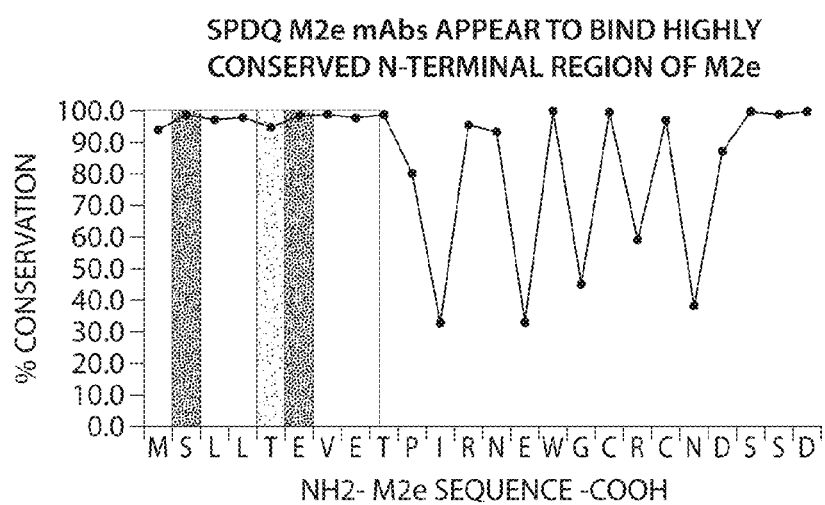
FIG. 5 is an illustration showing the anti-M2 antibodies bind a highly conserved region in the N-Terminus of M2e.

To determine whether the MAbs 8I10 and 23K12 bind to the same site, M2 protein representing influenza strain A/HK/483/1997 sequence was stably expressed in the CHO (Chinese Hamster Ovary) cell line DG44. Cells were treated with Cell Dissociation Buffer (Invitrogen), and harvested. Cells were washed in PBS containing 1% FBS, 0.2% $NaN_3$ (FACS buffer), and resuspended at $10^7$ cells/ml in FACS buffer supplemented with 100 µg/ml rabbit IgG. The cells were pre-bound by either MAb (or the 2N9 control) at 10 µg/ml for 1 hr at 4° C., and were then washed with FACS buffer. Directly conjugated AF647-8I10 or –23K12 (labeled with the AlexaFluor® 647 Protein Labeling kit (Invitrogen) was then used to stain the three pre-blocked cell samples at 1 µg/ml for $10^6$ cells per sample. Flow cytometric analyses proceeded as before with the FACSCanto. Data are average readouts from 3 separate experiments with standard error. Results are shown in FIG. 4.

Example 5

Binding of Human Anti-influenza Monoclonal Antibodies to M2 Variants and Truncated M2 Peptides The cross reactivity of mAbs 8i10 and 23K12 to other M2 peptide variants was assessed by ELISA. Peptide sequences are shown in Tables 7A and 7B. Additionally, a similar ELISA assay was used to determine binding activity to M2 truncated peptides.

In brief, each peptide was coated at 2 µg/mL to a flat bottom 384 well plate (Nunc) in 25 µL/well of PBS buffer overnight at 4° C. Plates were washed three times and blocked with 1% Milk/PBS for one hour at room temperature. After washing three times, MAb titers were added and incubated for one hour at room temperature. Diluted HRP conjugated goat anti-human immunoglobulin FC specific (Pierce) was added to each well after washing three times. Plates were incubated for one hour at room temperature and washed three times. 1-Step™ Ultra-TMB-ELISA (Pierce) was added at 25 µl/well, and the reaction proceeded in the dark at room temp. The assay was stopped with 25 µl/well 1N $H_2SO_4$, and light absorbance at 450 nm (A450) was read on a SpectroMax Plus plate reader. Results are shown in Tables 7A and 7B.

TABLE 7A

Cross reactivity binding of anti-M2 antibodies to variant M2 peptides.

| seqNo | Name | Size | Description | ELISA (OD 450) | | | |
|---|---|---|---|---|---|---|---|
| | | | | 14C2 | 8i10 | 23K12 | 2N9 |
| 1 | M2 | 23 aa | SLLTEVETPIRNEWGCRCNDSSD | + | − | − | − |
| 2 | M2SG | 23 aa | SLLTEVETPIRSEWGCRCNDSGD | + | − | − | − |
| 3 | M2EG | 23 aa | SLLTEVETPIRNEWECRCNGSSD | + | − | − | − |
| 4 | M2P | 23 aa | SLPTEVETPIRNEWGCRCNDSSD | + | − | − | − |
| 5 | M2G | 23 aa | SLLTEVETPIRNEWGCRCNGSSD | + | − | − | − |
| 6 | M2DLTGS | 23 aa | SLLTEVDTLTRNGWGCRCSDSSD | − | − | + | − |
| 7 | M2KNS | 23 aa | SLLTEVETPIRKEWGCNCSDSSD | + | − | − | − |
| 8 | M2LGS | 23 aa | SLLTEVETLIRNGWGCRCSDSSD | − | − | − | − |
| 9 | M2LTKGS | 23 aa | SLLTEVETLTKNGWGCRCSDSSD | − | − | − | − |
| 10 | M2SY | 23 aa | SLLTEVETPIRSEWGCRYNDSSD | + | − | − | − |
| 11 | M2TGEKS | 23 aa | SLLTEVETPTRNGWECKCSDSSD | + | − | − | − |
| 12 | M2HTGEKS | 23 aa | SLLTEVETHTRNGWECKCSDSSD | − | − | − | − |
| 13 | M2KTGEKS | 23 aa | SLLTEVKTPTRNGWECKCSDSSD | − | − | − | − |
| 14 | M2LTGS | 23 aa | SLLTEVETLTRNGWGCRCSDSSD | − | − | + | − |
| 15 | M2TDGEKS | 23 aa | SLLTEVETPTRDGWECKCSDSSD | + | − | − | − |
| 16 | M2TGS | 23 aa | SLLTEVETPTRNGWGCRCSDSSD | + | − | W | − |
| 17 | M2TGEK | 23 aa | SLLTEVETPTRNGWECKCNDSSD | + | − | − | − |
| 18 | M2LTGEKS | 23 aa | SLLTEVETLTRNGWECKCSDSSD | − | − | W | − |
| 19 | M2K | 23 aa | SLLTEVETPIRNEWGCKCNDSSD | + | W | + | − |
| 20 | M2FG | 23 aa | SFLTEVETPIRNEWGCRCNGSSD | + | W | − | − |
| 21 | M2TGE | 23 aa | SLLTEVETPTRNGWECRCNDSSD | + | − | − | − |
| 22 | M2KGENS | 23 aa | SLLTEVETPIRKGWECNCSDSSD | + | − | − | − |
| 23 | M2TES | 23 aa | SLLTEVETPTRNEWECRCSDSSD | + | − | − | − |
| 24 | M2GHTGKS | 23 aa | SLLTGVETHTRNGWGCKCSDSSD | − | − | − | − |
| 25 | M2PHTGS | 23 aa | SLLPEVETHTRNGWGCRCSDSSD | − | − | − | − |

Percentage compared relative to binding to wild-type peptide (Seq 1)
Note:
mAbs were tested at 5 μg/mL
>25%   − no binding
25-40% W weak binding
>40%   + positive binding

TABLE 7B

Binding activity of M2 antibodies to truncated M2 peptides.

| seqNo | Name | Size | Description | 14C2 | 8i10 | 23K12 | 2N9 |
|---|---|---|---|---|---|---|---|
| 1 | M2 | 23 aa | SLLTEVETPIRNEWGCRCNDSSD | 3.85 | 0.11 | 0.22 | 0.06 |
| 26 | M16 | 16 aa | LLTEVETPIRNEWGCR | 3.94 | 0.09 | 0.21 | 0.09 |
| 27 | M15 | 15 aa | LTEVETPIRNEWGCR | 3.95 | 0.09 | 0.21 | 0.09 |
| 28 | M12 | 12 aa | VETPIRNEWGCR | 0.15 | 0.09 | 0.20 | 0.09 |

TABLE 7B-continued

Binding activity of M2 antibodies to truncated M2 peptides.

| seqNo | Name | Size | Description | 14C2 | 8i10 | 23K12 | 2N9 |
|---|---|---|---|---|---|---|---|
| 29 | CM17 | 17 aa | ETPIRNEWGCRCNDSSD | 0.19 | 0.11 | 0.34 | 0.11 |
| 30 | CM16 | 16 aa | TPIRNEWGCRCNDSSD | 0.23 | 0.13 | 0.35 | 0.12 |
| 31 | CM15 | 15 aa | PIRNEWGCRCNDSSD | 0.19 | 0.12 | 0.34 | 0.11 |
| 32 | CM14 | 14 aa | IRNEWGCRCNDSSD | 0.23 | 0.14 | 0.36 | 0.13 |
| 33 | CM13 | 13 aa | RNEWGCRCNDSSD | 0.22 | 0.14 | 0.34 | 0.13 |
| 34 | CM12 | 12 aa | NEWGCRCNDSSD | 0.27 | 0.14 | 0.39 | 0.14 |
| 35 | NM17 | 17 aa | SLLTEVETPIRNEWGCR | 3.99 | 0.26 | 0.58 | 0.10 |
| 36 | NM16 | 16 aa | SLLTEVETPIRNEWGC | 3.90 | 0.29 | 0.62 | 0.09 |
| 37 | NM15 | 15 aa | SLLTEVETPIRNEWG | 3.97 | 0.12 | 0.30 | 0.11 |
| 38 | NM14 | 14 aa | SLLTEVETPIRNEW | 3.97 | 0.11 | 0.24 | 0.09 |
| 39 | NM13 | 13 aa | SLLTEVETPIRNE | 0.18 | 0.11 | 0.25 | 0.10 |
| 40 | NM12 | 12 aa | SLLTEVETPIRN | 0.20 | 0.10 | 0.24 | 0.09 |
| 41 | NM11 | 11 aa | SLLTEVETPIR | 0.21 | 0.13 | 0.30 | 0.12 |
| 42 | NM10 | 10 aa | SLLTEVETPI | 0.17 | 0.10 | 0.24 | 0.10 |
| 43 | NM8 | 8 aa | SLLTEVET | 0.15 | 0.10 | 0.20 | 0.09 |
| 44 | NM7 | 7 aa | SLLTEVE | 0.14 | 0.10 | 0.20 | 0.08 |
| 45 | NM9 | 9 aa | SLLTEVETP | 0.21 | 0.12 | 0.30 | 0.19 |
| 46 | M2e | 24 aa | MSLLTEVETPIRNEWGCRCNDSSD | 3.98 | 0.13 | 0.43 | 0.10 |
| CMV | HVIR1 | | | 0.16 | 0.11 | 0.21 | 3.99 |

Note:
mAbs were tested at 5 µg/mL

OTHER EMBODIMENTS

All publications and patent applications cited in this specification are herein incorporated by reference as if each individual publication or patent application is specifically and individually indicated to be incorporated by reference.

Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

SEQUENCE LISTING (1598 sequences)

SEQ ID NO: 1 - protein, 23 aa, Influenza A virus
SLLTEVETPIRNEWGCRCNDSSD

SEQ ID NO: 2 - protein, 23 aa, Influenza A virus
SLLTEVETPIRSEWGCRCNDSGD

SEQ ID NO: 3 - protein, 23 aa, Influenza A virus
SLLTEVETPIRNEWECRCNGSSD

SEQ ID NO: 4 - protein, 23 aa, Influenza A virus
SLPTEVETPIRNEWGCRCNDSSD

SEQ ID NO: 5 - protein, 23 aa, Influenza A virus
SLLTEVETPIRNEWGCRCNGSSD

SEQ ID NO: 6 - protein, 23 aa, Influenza A virus
SLLTEVDTLTRNGWGCRCSDSSD

SEQ ID NO: 7 - protein, 23 aa, Influenza A virus
SLLTEVETPIRKEWGCNCSDSSD

SEQ ID NO: 8 - protein, 23 aa, Influenza A virus
SLLTEVETLIRNGWGCRCSDSSD

SEQ ID NO: 9 - protein, 23 aa, Influenza A virus
SLLTEVETLTKNGWGCRCSDSSD

SEQ ID NO: 10 - protein, 23 aa, Influenza A virus
SLLTEVETPIRSEWGCRYNDSSD

SEQ ID NO: 11 - protein, 23 aa, Influenza A virus
SLLTEVETPTRNGWECKCSDSSD

SEQ ID NO: 12 - protein, 23 aa, Influenza A virus
SLLTEVETHTRNGWECKCSDSSD

SEQ ID NO: 13 - protein, 23 aa, Influenza A virus
SLLTEVKTPTRNGWECKCSDSSD

SEQ ID NO: 14 - protein, 23 aa, Influenza A virus
SLLTEVETLTRNGWGCRCSDSSD

SEQ ID NO: 15 - protein, 23 aa, Influenza A virus
SLLTEVETPTRDGWECKCSDSSD

SEQ ID NO: 16 - protein, 23 aa, Influenza A virus
SLLTEVETPTRNGWGCRCSDSSD

SEQ ID NO: 17 - protein, 23 aa, Influenza A virus
SLLTEVETPTRNGWECKCNDSSD

SEQ ID NO: 18 - protein, 23 aa, Influenza A virus
SLLTEVETLTRNGWECKCSDSSD

SEQ ID NO: 19 - protein, 23 aa, Influenza A virus
SLLTEVETPIRNEWGCKCNDSSD

SEQ ID NO: 20 - protein, 23 aa, Influenza A virus
SFLTEVETPIRNEWGCRCNGSSD

SEQ ID NO: 21 - protein, 23 aa, Influenza A virus
SLLTEVETPTRNGWECRCNDSSD

SEQ ID NO: 22 - protein, 23 aa, Influenza A virus
SLLTEVETPIRKGWECNCSDSSD

SEQ ID NO: 23 - protein, 23 aa, Influenza A virus
SLLTEVETPTRNEWECRCSDSSD

SEQ ID NO: 24 - protein, 23 aa, Influenza A virus
SLLTGVETHTRNGWGCKCSDSSD

SEQ ID NO: 25 - protein, 23 aa, Influenza A virus
SLLPEVETHTRNGWGCRCSDSSD

SEQ ID NO: 26 - protein, 16 aa, Influenza A virus
LLTEVETPIRNEWGCR

SEQ ID NO: 27 - protein, 15 aa, Influenza A virus
LTEVETPIRNEWGCR

SEQ ID NO: 28 - protein, 12 aa, Influenza A virus
VETPIRNEWGCR

SEQ ID NO: 29 - protein, 17 aa, Influenza A virus
ETPIRNEWGCRCNDSSD

SEQ ID NO: 30 - protein, 16 aa, Influenza A virus
TPIRNEWGCRCNDSSD

SEQ ID NO: 31 - protein, 15 aa, Influenza A virus
PIRNEWGCRCNDSSD

SEQ ID NO: 32 - protein, 14 aa, Influenza A virus
IRNEWGCRCNDSSD

SEQ ID NO: 33 - protein, 13 aa, Influenza A virus
RNEWGCRCNDSSD

SEQ ID NO: 34 - protein, 12 aa, Influenza A virus
NEWGCRCNDSSD

SEQ ID NO: 35 - protein, 17 aa, Influenza A virus
SLLTEVETPIRNEWGCR

SEQ ID NO: 36 - protein, 16 aa, Influenza A virus
SLLTEVETPIRNEWGC

SEQ ID NO: 37 - protein, 15 aa, Influenza A virus
SLLTEVETPIRNEWG

SEQ ID NO: 38 - protein, 14 aa, Influenza A virus
SLLTEVETPIRNEW

SEQ ID NO: 39 - protein, 13 aa, Influenza A virus
SLLTEVETPIRNE

SEQ ID NO: 40 - protein, 12 aa, Influenza A virus
SLLTEVETPIRN

SEQ ID NO: 41 - protein, 11 aa, Influenza A virus
SLLTEVETPIR

SEQ ID NO: 42 - protein, 10 aa, Influenza A virus
SLLTEVETPI

SEQ ID NO: 43 - protein, 8 aa, Influenza A virus
SLLTEVET

SEQ ID NO: 44 - protein, 7 aa, Influenza A virus
SLLTEVE

SEQ ID NO: 45 - protein, 9 aa, Influenza A virus
SLLTEVETP

SEQ ID NO: 46 - protein, 24 aa, Influenza A virus
MSLLTEVETPIRNEWGCRCNDSSD

SEQ ID NO: 47 - protein, 5 aa, Influenza A virus
SLLTE

SEQ ID NO: 48 - protein, 24 aa, Influenza A virus
MSLLTEVETPTRNEWGCRCNDSSD

SEQ ID NO: 49 - protein, 24 aa, Influenza A virus
MSLLTEVETPTKNEWECRCNDSSD

SEQ ID NO: 50 - protein, 24 aa, Influenza A virus
MSLLTEVETPIRNEWECRCNDSSD

SEQ ID NO: 51 - protein, 24 aa, Influenza A virus
MSLLTEVETPIRNGWECKCNDSSD

SEQ ID NO: 52 - protein, 24 aa, Influenza A virus
MSLLTEVETPIRSEWGCRCNDSSD

SEQ ID NO: 53 - protein, 24 aa, Influenza A virus
MSFLPEVETPIRNEWGCRCNDSSD

SEQ ID NO: 54 - protein, 24 aa, Influenza A virus
MSLLTEVETPIRNEWGCRCNDSSN

SEQ ID NO: 55 - protein, 24 aa, Influenza A virus
MSLLTEVETPIRKEWGCRCNDSSD

SEQ ID NO: 56 - protein, 24 aa, Influenza A virus
MSFLTEVETPIRNEWGCRCNDSSD

SEQ ID NO: 57 - protein, 24 aa, Influenza A virus
MSLPTEVETPIRSEWGCRCNDSSD

SEQ ID NO: 58 - protein, 24 aa, Influenza A virus
MSLLPEVETPIRNEWGCRCNDSSD

SEQ ID NO: 59 - protein, 24 aa, Influenza A virus
MSLLPEVETPIRNGWGCRCNDSSD

SEQ ID NO: 60 - protein, 24 aa, Influenza A virus
MSLLTEVETPTRNGWECRCSGSSD

SEQ ID NO: 61 - protein, 24 aa, Influenza A virus
MSLLTEVETPIRNEWEYRCNDSSD

SEQ ID NO: 62 - protein, 24 aa, Influenza A virus
MSLLTEVETPIRNEWEYRCSDSSD

SEQ ID NO: 63 - protein, 24 aa, Influenza A virus
MSLLTEVETPTRNGWECRYSDSSD

SEQ ID NO: 64 - protein, 24 aa, Influenza A virus
MSFLTEVETLTRNGWECRCSDSSD

SEQ ID NO: 65 - protein, 24 aa, Influenza A virus
MSLLTEVETLTRNGWECKCRDSSD

SEQ ID NO: 66 - protein, 24 aa, Influenza A virus
MSLLTEVETPIRNEWGCRCNDSSD

SEQ ID NO: 67 - protein, 24 aa, Influenza A virus
MSLLTEVETPIRSEWGCRCNDSGD

SEQ ID NO: 68 - protein, 24 aa, Influenza A virus
MSLLTEVETPIRNEWECRCNGSSD

SEQ ID NO: 69 - protein, 24 aa, Influenza A virus
MSLPTEVETPIRNEWGCRCNDSSD

SEQ ID NO: 70 - protein, 24 aa, Influenza A virus
MSLLTEVETPIRNEWGCRCNGSSD

SEQ ID NO: 71 - protein, 24 aa, Influenza A virus
MSLLTEVDTLTRNGWGCRCSDSSD

SEQ ID NO: 72 - protein, 24 aa, Influenza A virus
MSLLTEVETLTKNGWGCRCSDSSD

SEQ ID NO: 73 - protein, 24 aa, Influenza A virus
MSLLTEVETPTRNGWECKCSDSSD

SEQ ID NO: 74 - protein, 24 aa, Influenza A virus
MSLLTEVETHTRNGWECKCSDSSD

SEQ ID NO: 75 - protein, 24 aa, Influenza A virus
MSLLTEVKTPTRNGWECKCSDSSD

SEQ ID NO: 76 - protein, 24 aa, Influenza A virus
MSLLTEVETLTRNGWGCRCSDSSD

SEQ ID NO: 77 - protein, 24 aa, Influenza A virus
MSLLTEVETPTRDGWECKCSDSSD

SEQ ID NO: 78 - protein, 24 aa, Influenza A virus
MSLLTEVETPTRNGWGCRCSDSSD

SEQ ID NO: 79 - protein, 24 aa, Influenza A virus
MSLLTEVETPTRNGWECKCNDSSD

SEQ ID NO: 80 - protein, 24 aa, Influenza A virus
MSLLTEVETLTRNGWECKCSDSSD

SEQ ID NO: 81 - protein, 24 aa, Influenza A virus
MSLLTEVETPIRNEWGCKCNDSSD

SEQ ID NO: 82 - protein, 24 aa, Influenza A virus
MSFLTEVETPIRNEWGCRCNGSSD

SEQ ID NO: 83 - protein, 24 aa, Influenza A virus
MSLLTEVETPTRNGWECRCNDSSD

SEQ ID NO: 84 - protein, 24 aa, Influenza A virus
MSLLTEVETPIRKGWECNCSDSSD

SEQ ID NO: 85 - protein, 24 aa, Influenza A virus
MSLLTEVETPTRNEWECRCSDSSD

SEQ ID NO: 86 - protein, 24 aa, Influenza A virus
MSLLTGVETHTRNGWGCKCSDSSD

SEQ ID NO: 87 - protein, 24 aa, Influenza A virus
MSLLPEVETHTRNGWGCRCSDSSD

SEQ ID NO: 88 - protein, 119 aa, Artificial Sequence
  8I10 VH sequence
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVS

SEQ ID NO: 89 - DNA, 357 bp, Artificial Sequence
  8I10 VH sequence
caggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgtctcg

SEQ ID NO: 90 - protein, 107 aa, Artificial Sequence
  8I10 VL sequence
DIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIK

SEQ ID NO: 91 - DNA, 322 bp, Artificial Sequence
  8I10 VL sequence
gacatccagatgacccagtctccatcctccctgtctgcatctgtaggagacagagtcaccatcacttgccgggcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggagatcaaac

SEQ ID NO: 92 - protein, 5 aa, Artificial Sequence
  CDR
NYYWS

SEQ ID NO: 93 - protein, 16 aa, Artificial Sequence
  CDR
FIYYGGNTKYNPSLKS

SEQ ID NO: 94 - protein, 11 aa, Artificial Sequence
  CDR
ASCSGGYCILD

SEQ ID NO: 95 - protein, 11 aa, Artificial Sequence
  CDR
RASQNIYKYLN

SEQ ID NO: 96 - protein, 7 aa, Artificial Sequence
  CDR
AASGLQS

SEQ ID NO: 97 - protein, 9 aa, Artificial Sequence
  CDR
QQSYSPPLT

SEQ ID NO: 98 - protein, 6 aa, Artificial Sequence
  CDR
GSSISN

SEQ ID NO: 99 - protein, 9 aa, Artificial Sequence
  CDR
FIYYGGNTK

SEQ ID NO: 100 - protein, 119 aa, Artificial Sequence; identical to SEQ ID NO: 88
  21B15 VH sequence

SEQ ID NO: 101 - DNA, 357 bp, Artificial Sequence; identical to SEQ ID NO: 89
  21B15 VH sequence

SEQ ID NO: 102 - protein, 107 aa, Artificial Sequence
  21B15 VL sequence
DIQVTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVDIK

SEQ ID NO: 103 - DNA, 322 bp, Artificial Sequence
  21B15 VL sequence
gacatccaggtgacccagtctccatcctccctgtctgcatctgtaggagacagagtcaccatcacttgccgcgcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggatatcaaac

SEQ ID NO: 104 - protein, 119 aa, Artificial Sequence
  23K12 VH sequence
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 105 - DNA, 357 bp, Artificial Sequence
  23K12 VH sequence
gaggtgcagctggtggagtctgggggaggcttggtccagcctggggggtccctgagaatctcctgtgcagcctctggattcaccgtcagtagcaactacatgagttgggtccgccaggctccagggaaggggctggagtgggtctcagttatttatagtggtggtagcacatactacgcagactccgtgaagggcagattctccttctccagagacaactccaagaacacagtgtttcttcaaatgaacagcctgagagccgaggacacggctgtgtattactgtgcgagatgtctgagcaggatgcggggttacggtttagacgtctggggccaagggaccacggtcaccgtctcg

SEQ ID NO: 106 - protein, 106 aa, Artificial Sequence
  23K12 VL sequence
DIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 107 - DNA, 318 bp, Artificial Sequence
  23K12 VL sequence
gacatccagatgacccagtctccatcctccctgtctgcatctgtaggagacagagtcaccatcacttgccggacaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcggtctgcaacctgaagattttgcaacctactactgtcaacagagttacagtatgcctgcctttggccaggggaccaagctggagatcaaa

SEQ ID NO: 108 - protein, 5 aa, Artificial Sequence
  CDR
SNYMS

SEQ ID NO: 109 - protein, 15 aa, Artificial Sequence
  CDR
VIYSGGSTYYADSVK

SEQ ID NO: 110 - protein, 12 aa, Artificial Sequence
  CDR
CLSRMRGYGLDV

SEQ ID NO: 111 - protein, 11 aa, Artificial Sequence
  CDR
RTSQSISSYLN

SEQ ID NO: 112 - protein, 13 aa, Artificial Sequence
  CDR
AASSLQSGVPSRF

SEQ ID NO: 113 - protein, 8 aa, Artificial Sequence
  CDR
QQSYSMPA

SEQ ID NO: 114 - protein, 7 aa, Artificial Sequence
  CDR
GFTVSSN

SEQ ID NO: 115 - protein, 9 aa, Artificial Sequence
  CDR
VIYSGGSTY

SEQ ID NO: 116 - protein, 33 aa, Artificial Sequence
  epitope peptide
CLTEVETPIRNEWGSRCSLLTEVETPIRNEWGC

SEQ ID NO: 117 - protein, 29 aa, Artificial Sequence
  epitope peptide
CLLTEVETPIRNEWGSCSLLTEVETPIRC

SEQ ID NO: 118 - protein, 24 aa, Artificial Sequence
  epitope peptide
CSLLTEVETPIRNECSLLTEVETC

SEQ ID NO: 119 - protein, 30 aa, Artificial Sequence
  epitope peptide
CLTEVETPIRNEWGSRCSLLTEVETPIRNC

SEQ ID NO: 120 - protein, 26 aa, Artificial Sequence
  epitope peptide
CSLLTEVETPIRNCSLLTEVETPIRC

SEQ ID NO: 121 - protein, 25 aa, Artificial Sequence
  epitope peptide
CSLLTEVETPIRCSLLTEVETPIRC

SEQ ID NO: 122 - protein, 25 aa, Artificial Sequence
  epitope peptide
CSLLTEVETPIRNEWCSLLTEVETC

SEQ ID NO: 123 - protein, 31 aa, Artificial Sequence
  epitope peptide
CSLLTEVETPIRNECLTEVETPIRNEWGSRC

SEQ ID NO: 124 - protein, 23 aa, Artificial Sequence
  epitope peptide
CSLLTEVETPCSLLTEVETPIRC

SEQ ID NO: 125 - protein, 33 aa, Artificial Sequence
  epitope peptide
CTEVETPIRNEWGSRSCSLLTEVETPIRNEWGC

SEQ ID NO: 126 - protein, 30 aa, Artificial Sequence
  epitope peptide
CETPIRNEWGSRSNDSCSLLTEVETPIRNC

SEQ ID NO: 127 - protein, 19 aa, Artificial Sequence
  epitope peptide
CSLLTEVETCSLLTEVETC

SEQ ID NO: 128 - protein, 21 aa, Artificial Sequence
  epitope peptide
CSLLTEVETCSLLTEVETPIC

SEQ ID NO: 129 - protein, 27 aa, Artificial Sequence
  epitope peptide
CSLLTEVETPIRNCSLLTEVETPIRNC

SEQ ID NO: 130 - protein, 27 aa, Artificial Sequence
  epitope peptide
CSLLTEVETPIRNECSLLTEVETPIRC

SEQ ID NO: 131 - protein, 26 aa, Artificial Sequence
  epitope peptide
CSLLTEVETPIRCSLLTEVETPIRNC

SEQ ID NO: 132 - protein, 28 aa, Artificial Sequence
  epitope peptide
CVETPIRNEWGSRSNDCSLLTEVETPIC

SEQ ID NO: 133 - protein, 28 aa, Artificial Sequence
  epitope peptide
CSLLTEVETPIRNECSLLTEVETPIRNC

SEQ ID NO: 134 - protein, 23 aa, Artificial Sequence
  epitope peptide
CSLLTEVETCSLLTEVETPIRNC

SEQ ID NO: 135 - protein, 29 aa, Artificial Sequence
  epitope peptide
CSLLTEVETPIRNCSLLTEVETPIRNEWC

SEQ ID NO: 136 - protein, 26 aa, Artificial Sequence
  epitope peptide
CLTEVETPIRNEWGSRCSLLTEVETC

SEQ ID NO: 137 - protein, 22 aa, Artificial Sequence
  epitope peptide
CSLLTEVETPCSLLTEVETPIC

SEQ ID NO: 138 - protein, 33 aa, Artificial Sequence
  epitope peptide
CSLLTEVETPIRNEWGCLLTEVETPIRNEWGSC

SEQ ID NO: 139 - protein, 25 aa, Artificial Sequence
  epitope peptide
CSLLTEVETPIRNCSLLTEVETPIC

SEQ ID NO: 140 - protein, 33 aa, Artificial Sequence
  epitope peptide
CSLLTEVETPIRNEWGCSLLTEVETPIRNEWGC

SEQ ID NO: 141 - protein, 32 aa, Artificial Sequence
  epitope peptide
CSLLTEVETPIRNEWCSLLTEVETPIRNEWGC

SEQ ID NO: 142 - protein, 20 aa, Artificial Sequence
  epitope peptide
CSLLTEVETCSLLTEVETPC

SEQ ID NO: 143 - protein, 30 aa, Artificial Sequence
  epitope peptide
CSLLTEVETPIRNEWGCSLLTEVETPIRNC

SEQ ID NO: 144 - protein, 24 aa, Artificial Sequence
  epitope peptide
CSLLTEVETPIRNCSLLTEVETPC

SEQ ID NO: 145 - protein, 26 aa, Artificial Sequence
  epitope peptide
CSLLTEVETPIRNECSLLTEVETPIC

SEQ ID NO: 146 - protein, 30 aa, Artificial Sequence
  epitope peptide
CSLLTEVETPIRNECSLLTEVETPIRNEWC

SEQ ID NO: 147 - protein, 22 aa, Artificial Sequence
  epitope peptide
CSLLTEVETPIRCSLLTEVETC

SEQ ID NO: 148 - protein, 30 aa, Artificial Sequence
  epitope peptide
CSLLTEVETPIRNCSLLTEVETPIRNEWGC

SEQ ID NO: 149 - protein, 33 aa, Artificial Sequence
  epitope peptide
CTEVETPIRNEWGSRSCLTEVETPIRNEWGSRC

SEQ ID NO: 150 - protein, 25 aa, Artificial Sequence
  epitope peptide
CSLLTEVETCSLLTEVETPIRNEWC

SEQ ID NO: 151 - protein, 24 aa, Artificial Sequence
  epitope peptide
CSLLTEVETPIRCSLLTEVETPIC

SEQ ID NO: 152 - protein, 31 aa, Artificial Sequence
  epitope peptide
CSLLTEVETPIRNECSLLTEVETPIRNEWGC

SEQ ID NO: 153 - protein, 24 aa, Artificial Sequence
  epitope peptide
CSLLTEVETPCSLLTEVETPIRNC

SEQ ID NO: 154 - protein, 31 aa, Artificial Sequence
  epitope peptide
CETPIRNEWGSRSNDSCSLLTEVETPIRNEC

SEQ ID NO: 155 - protein, 28 aa, Artificial Sequence
  epitope peptide
CSLLTEVETPIRNEWCSLLTEVETPIRC

SEQ ID NO: 156 - protein, 21 aa, Artificial Sequence
  epitope peptide
CSLLTEVETPCSLLTEVETPC

SEQ ID NO: 157 - protein, 29 aa, Artificial Sequence
  epitope peptide
CSLLTEVETPIRNEWGCSLLTEVETPIRC

SEQ ID NO: 158 - protein, 26 aa, Artificial Sequence
  epitope peptide
CSLLTEVETPCSLLTEVETPIRNEWC

SEQ ID NO: 159 - protein, 33 aa, Artificial Sequence
  epitope peptide
CSLLTEVETPIRNEWGCVETPIRNEWGSRSNDC

SEQ ID NO: 160 - protein, 29 aa, Artificial Sequence
  epitope peptide
CSLLTEVETPIRCLLTEVETPIRNEWGSC

SEQ ID NO: 161 - protein, 26 aa, Artificial Sequence
  epitope peptide
CPIRNEWGSRSNDSSDCSLLTEVETC

SEQ ID NO: 162 - protein, 29 aa, Artificial Sequence
  epitope peptide
CLTEVETPIRNEWGSRCSLLTEVETPIRC

SEQ ID NO: 163 - protein, 22 aa, Artificial Sequence
  epitope peptide
CSLLTEVETCSLLTEVETPIRC

SEQ ID NO: 164 - protein, 25 aa, Artificial Sequence
  epitope peptide
CSLLTEVETPIRNECSLLTEVETPC

SEQ ID NO: 165 - protein, 27 aa, Artificial Sequence
  epitope peptide
CSLLTEVETPIRCSLLTEVETPIRNEC

SEQ ID NO: 166 - protein, 23 aa, Artificial Sequence
  epitope peptide
CSLLTEVETPIRNCSLLTEVETC

SEQ ID NO: 167 - protein, 29 aa, Artificial Sequence
  epitope peptide
CSLLTEVETPIRCSLLTEVETPIRNEWGC

SEQ ID NO: 168 - protein, 29 aa, Artificial Sequence
  epitope peptide
CVETPIRNEWGSRSNDCSLLTEVETPIRC

SEQ ID NO: 169 - protein, 29 aa, Artificial Sequence
  epitope peptide
CTPIRNEWGSRSNDSSCSLLTEVETPIRC

SEQ ID NO: 170 - protein, 29 aa, Artificial Sequence
  epitope peptide
CSLLTEVETPIRCLTEVETPIRNEWGSRC

SEQ ID NO: 171 - protein, 24 aa, Artificial Sequence
  epitope peptide
CSLLTEVETCSLLTEVETPIRNEC

SEQ ID NO: 172 - protein, 29 aa, Artificial Sequence
  epitope peptide
CEVETPIRNEWGSRSNCSLLTEVETPIRC

SEQ ID NO: 173 - protein, 28 aa, Artificial Sequence
  epitope peptide
CSLLTEVETPIRCSLLTEVETPIRNEWC

SEQ ID NO: 174 - protein, 31 aa, Artificial Sequence
  epitope peptide
CSLLTEVETPIRNEWCSLLTEVETPIRNEWC

SEQ ID NO: 175 - protein, 33 aa, Artificial Sequence
  epitope peptide
CSLLTEVETPIRNEWGCLTEVETPIRNEWGSRC

SEQ ID NO: 176 - protein, 29 aa, Artificial Sequence
  epitope peptide
CPIRNEWGSRSNDSSDCSLLTEVETPIRC

SEQ ID NO: 177 - protein, 27 aa, Artificial Sequence
  epitope peptide
CSLLTEVETPIRNEWCSLLTEVETPIC

SEQ ID NO: 178 - protein, 30 aa, Artificial Sequence
  epitope peptide
CLLTEVETPIRNEWGSCSLLTEVETPIRNC

SEQ ID NO: 179 - protein, 26 aa, Artificial Sequence
  epitope peptide
CSLLTEVETCLLTEVETPIRNEWGSC

SEQ ID NO: 180 - protein, 29 aa, Artificial Sequence
  epitope peptide
CSLLTEVETPIRNEWCSLLTEVETPIRNC

SEQ ID NO: 181 - protein, 23 aa, Artificial Sequence
  epitope peptide
CSLLTEVETPIRCSLLTEVETPC

SEQ ID NO: 182 - protein, 27 aa, Artificial Sequence
  epitope peptide
CSLLTEVETPCLLTEVETPIRNEWGSC

SEQ ID NO: 183 - protein, 28 aa, Artificial Sequence
  epitope peptide
CSLLTEVETPIRNCSLLTEVETPIRNEC

SEQ ID NO: 184 - protein, 29 aa, Artificial Sequence
  epitope peptide
CTEVETPIRNEWGSRSCSLLTEVETPIRC

SEQ ID NO: 185 - protein, 30 aa, Artificial Sequence
  epitope peptide
CTPIRNEWGSRSNDSSCSLLTEVETPIRNC

SEQ ID NO: 186 - protein, 27 aa, Artificial Sequence
  epitope peptide
CSLLTEVETPCSLLTEVETPIRNEWGC

SEQ ID NO: 187 - protein, 21 aa, Artificial Sequence
  epitope peptide
CSLLTEVETPICSLLTEVETC

SEQ ID NO: 188 - protein, 32 aa, Artificial Sequence
  epitope peptide
CLTEVETPIRNEWGSRCSLLTEVETPIRNEWC

SEQ ID NO: 189 - protein, 26 aa, Artificial Sequence
  epitope peptide
CSLLTEVETPIRNEWCSLLTEVETPC

SEQ ID NO: 190 - protein, 29 aa, Artificial Sequence
  epitope peptide
CETPIRNEWGSRSNDSCSLLTEVETPIRC

SEQ ID NO: 191 - protein, 28 aa, Artificial Sequence
  epitope peptide
CLTEVETPIRNEWGSRCSLLTEVETPIC

SEQ ID NO: 192 - protein, 30 aa, Artificial Sequence
  epitope peptide
CSLLTEVETPIRNCLLTEVETPIRNEWGSC

SEQ ID NO: 193 - protein, 25 aa, Artificial Sequence
  epitope peptide
CSLLTEVETPCSLLTEVETPIRNEC

SEQ ID NO: 194 - protein, 30 aa, Artificial Sequence
  epitope peptide
CVETPIRNEWGSRSNDCSLLTEVETPIRNC

SEQ ID NO: 195 - protein, 30 aa, Artificial Sequence
  epitope peptide
CSLLTEVETPIRNCLTEVETPIRNEWGSRC

SEQ ID NO: 196 - protein, 30 aa, Artificial Sequence
  epitope peptide
CEVETPIRNEWGSRSNCSLLTEVETPIRNC

SEQ ID NO: 197 - protein, 28 aa, Artificial Sequence
  epitope peptide
CSLLTEVETPIRNEWGCSLLTEVETPIC

SEQ ID NO: 198 - protein, 20 aa, Artificial Sequence
  epitope peptide
CSLLTEVETPCSLLTEVETC

SEQ ID NO: 199 - protein, 29 aa, Artificial Sequence
  epitope peptide
CSLLTEVETPIRCTEVETPIRNEWGSRSC

SEQ ID NO: 200 - protein, 26 aa, Artificial Sequence
  epitope peptide
CSLLTEVETPIRNEWGCSLLTEVETC

SEQ ID NO: 201 - protein, 26 aa, Artificial Sequence
  epitope peptide
CEVETPIRNEWGSRSNCSLLTEVETC

SEQ ID NO: 202 - protein, 30 aa, Artificial Sequence
  epitope peptide
CPIRNEWGSRSNDSSDCSLLTEVETPIRNC

SEQ ID NO: 203 - protein, 24 aa, Artificial Sequence
  epitope peptide
CSLLTEVETPICSLLTEVETPIRC

SEQ ID NO: 204 - protein, 30 aa, Artificial Sequence
  epitope peptide
CTEVETPIRNEWGSRSCSLLTEVETPIRNC

SEQ ID NO: 205 - protein, 33 aa, Artificial Sequence
  epitope peptide
CLLTEVETPIRNEWGSCSLLTEVETPIRNEWGC

SEQ ID NO: 206 - protein, 31 aa, Artificial Sequence
  epitope peptide
CSLLTEVETPIRNEWGCSLLTEVETPIRNEC

SEQ ID NO: 207 - protein, 22 aa, Artificial Sequence
  epitope peptide
CSLLTEVETPICSLLTEVETPC

SEQ ID NO: 208 - protein, 25 aa, Artificial Sequence
  epitope peptide
CSLLTEVETPICSLLTEVETPIRNC

SEQ ID NO: 209 - protein, 29 aa, Artificial Sequence
  epitope peptide
CSLLTEVETPIRCEVETPIRNEWGSRSNC

SEQ ID NO: 210 - protein, 30 aa, Artificial Sequence
  epitope peptide
CSLLTEVETPIRNCTEVETPIRNEWGSRSC

SEQ ID NO: 211 - protein, 27 aa, Artificial Sequence
  epitope peptide
CSLLTEVETPICSLLTEVETPIRNEWC

SEQ ID NO: 212 - protein, 32 aa, Artificial Sequence
  epitope peptide
CSLLTEVETPIRNEWGCSLLTEVETPIRNEWC

SEQ ID NO: 213 - protein, 26 aa, Artificial Sequence
  epitope peptide
CETPIRNEWGSRSNDSCSLLTEVETC

SEQ ID NO: 214 - protein, 32 aa, Artificial Sequence
  epitope peptide
CSLLTEVETPIRNEWCLLTEVETPIRNEWGSC

SEQ ID NO: 215 - protein, 26 aa, Artificial Sequence
  epitope peptide
CSLLTEVETCLTEVETPIRNEWGSRC

SEQ ID NO: 216 - protein, 28 aa, Artificial Sequence
  epitope peptide
CTEVETPIRNEWGSRSCSLLTEVETPIC

SEQ ID NO: 217 - protein, 27 aa, Artificial Sequence
  epitope peptide
CSLLTEVETPIRNEWGCSLLTEVETPC

SEQ ID NO: 218 - protein, 32 aa, Artificial Sequence
  epitope peptide
CLLTEVETPIRNEWGSCSLLTEVETPIRNEWC

SEQ ID NO: 219 - protein, 28 aa, Artificial Sequence
  epitope peptide
CEVETPIRNEWGSRSNCSLLTEVETPIC

SEQ ID NO: 220 - protein, 29 aa, Artificial Sequence
  epitope peptide
CSLLTEVETPIRNECSLLTEVETPIRNEC

SEQ ID NO: 221 - protein, 27 aa, Artificial Sequence
  epitope peptide
CSLLTEVETPCLTEVETPIRNEWGSRC

SEQ ID NO: 222 - protein, 27 aa, Artificial Sequence
  epitope peptide
CSLLTEVETPCTEVETPIRNEWGSRSC

SEQ ID NO: 223 - protein, 26 aa, Artificial Sequence
  epitope peptide
CVETPIRNEWGSRSNDCSLLTEVETC

SEQ ID NO: 224 - protein, 28 aa, Artificial Sequence
  epitope peptide
CSLLTEVETPICLLTEVETPIRNEWGSC

SEQ ID NO: 225 - protein, 32 aa, Artificial Sequence
  epitope peptide
CTEVETPIRNEWGSRSCSLLTEVETPIRNEWC

SEQ ID NO: 226 - protein, 26 aa, Artificial Sequence
  epitope peptide
CTEVETPIRNEWGSRSCSLLTEVETC

SEQ ID NO: 227 - protein, 31 aa, Artificial Sequence
  epitope peptide
CSLLTEVETPIRNECLLTEVETPIRNEWGSC

SEQ ID NO: 228 - protein, 27 aa, Artificial Sequence
  epitope peptide
CLTEVETPIRNEWGSRCSLLTEVETPC

SEQ ID NO: 229 - protein, 27 aa, Artificial Sequence
  epitope peptide
CEVETPIRNEWGSRSNCSLLTEVETPC

SEQ ID NO: 230 - protein, 26 aa, Artificial Sequence
  epitope peptide
CTPIRNEWGSRSNDSSCSLLTEVETC

SEQ ID NO: 231 - protein, 28 aa, Artificial Sequence
  epitope peptide
CTPIRNEWGSRSNDSSCSLLTEVETPIC

SEQ ID NO: 232 - protein, 27 aa, Artificial Sequence
  epitope peptide
CETPIRNEWGSRSNDSCSLLTEVETPC

SEQ ID NO: 233 - protein, 33 aa, Artificial Sequence
  epitope peptide
CEVETPIRNEWGSRSNCSLLTEVETPIRNEWGC

SEQ ID NO: 234 - protein, 32 aa, Artificial Sequence
  epitope peptide
CVETPIRNEWGSRSNDCSLLTEVETPIRNEWC

SEQ ID NO: 235 - protein, 28 aa, Artificial Sequence
  epitope peptide
CSLLTEVETPICLTEVETPIRNEWGSRC

SEQ ID NO: 236 - protein, 28 aa, Artificial Sequence
  epitope peptide
CSLLTEVETPICSLLTEVETPIRNEWGC

SEQ ID NO: 237 - protein, 28 aa, Artificial Sequence
  epitope peptide
CETPIRNEWGSRSNDSCSLLTEVETPIC

SEQ ID NO: 238 - protein, 32 aa, Artificial Sequence
  epitope peptide
CEVETPIRNEWGSRSNCSLLTEVETPIRNEWC

SEQ ID NO: 239 - protein, 26 aa, Artificial Sequence
  epitope peptide
CSLLTEVETCEVETPIRNEWGSRSNC

SEQ ID NO: 240 - protein, 31 aa, Artificial Sequence
  epitope peptide
CLTEVETPIRNEWGSRCSLLTEVETPIRNEC

SEQ ID NO: 241 - protein, 30 aa, Artificial Sequence
  epitope peptide
CSLLTEVETPIRNEWCSLLTEVETPIRNEC

SEQ ID NO: 242 - protein, 27 aa, Artificial Sequence
  epitope peptide
CVETPIRNEWGSRSNDCSLLTEVETPC

SEQ ID NO: 243 - protein, 33 aa, Artificial Sequence
  epitope sequence
CTPIRNEWGSRSNDSSCSLLTEVETPIRNEWGC

SEQ ID NO: 244 - protein, 31 aa, Artificial Sequence
  epitope sequence
CLLTEVETPIRNEWGSCSLLTEVETPIRNEC

SEQ ID NO: 245 - protein, 23 aa, Artificial Sequence
  epitope peptide
CSLLTEVETPICSLLTEVETPIC

SEQ ID NO: 246 - protein, 27 aa, Artificial Sequence
  epitope peptide
CTEVETPIRNEWGSRSCSLLTEVETPC

SEQ ID NO: 247 - protein, 27 aa, Artificial Sequence
  epitope peptide
CTPIRNEWGSRSNDSSCSLLTEVETPC

SEQ ID NO: 248 - protein, 31 aa, Artificial Sequence
  epitope peptide
CPIRNEWGSRSNDSSDCSLLTEVETPIRNEC

SEQ ID NO: 249 - protein, 32 aa, Artificial Sequence
  epitope peptide
CPIRNEWGSRSNDSSDCSLLTEVETPIRNEWC

SEQ ID NO: 250 - protein, 26 aa, Artificial Sequence
  epitope peptide
CSLLTEVETCTEVETPIRNEWGSRSC

SEQ ID NO: 251 - protein, 32 aa, Artificial Sequence
  epitope peptide
CETPIRNEWGSRSNDSCSLLTEVETPIRNEWC

SEQ ID NO: 252 - protein, 28 aa, Artificial Sequence
  epitope peptide
CLLTEVETPIRNEWGSCSLLTEVETPIC

SEQ ID NO: 253 - protein, 30 aa, Artificial Sequence
  epitope peptide
CSLLTEVETPIRNCEVETPIRNEWGSRSNC

SEQ ID NO: 254 - protein, 26 aa, Artificial Sequence
  epitope peptide
CLLTEVETPIRNEWGSCSLLTEVETC

SEQ ID NO: 255 - protein, 33 aa, Artificial Sequence
  epitope peptide
CETPIRNEWGSRSNDSCSLLTEVETPIRNEWGC

SEQ ID NO: 256 - protein, 33 aa, Artificial Sequence
  epitope peptide
CPIRNEWGSRSNDSSDCSLLTEVETPIRNEWGC

SEQ ID NO: 257 - protein, 33 aa, Artificial Sequence
  epitope peptide
CVETPIRNEWGSRSNDCSLLTEVETPIRNEWGC

SEQ ID NO: 258 - protein, 31 aa, Artificial Sequence
  epitope peptide
CSLLTEVETPIRNECTEVETPIRNEWGSRSC

SEQ ID NO: 259 - protein, 27 aa, Artificial Sequence
  epitope peptide
CPIRNEWGSRSNDSSDCSLLTEVETPC

SEQ ID NO: 260 - protein, 28 aa, Artificial Sequence
  epitope peptide
CSLLTEVETPICEVETPIRNEWGSRSNC

SEQ ID NO: 261 - protein, 31 aa, Artificial Sequence
  epitope peptide
CTEVETPIRNEWGSRSCSLLTEVETPIRNEC

SEQ ID NO: 262 - protein, 30 aa, Artificial Sequence
  epitope peptide
CSLLTEVETPIRNCVETPIRNEWGSRSNDC

SEQ ID NO: 263 - protein, 33 aa, Artificial Sequence
  epitope peptide
CSLLTEVETPIRNEWGCTEVETPIRNEWGSRSC

SEQ ID NO: 264 - protein, 26 aa, Artificial Sequence
  epitope peptide
CSLLTEVETCVETPIRNEWGSRSNDC

SEQ ID NO: 265 - protein, 27 aa, Artificial Sequence
  epitope peptide
CSLLTEVETPCVETPIRNEWGSRSNDC

SEQ ID NO: 266 - protein, 31 aa, Artificial Sequence
  epitope peptide
CTPIRNEWGSRSNDSSCSLLTEVETPIRNEC

SEQ ID NO: 267 - protein, 28 aa, Artificial Sequence
  epitope peptide
CPIRNEWGSRSNDSSDCSLLTEVETPIC

SEQ ID NO: 268 - protein, 23 aa, Artificial Sequence
  epitope peptide
SLLTEVETPIRNECGCRCNDSSD

SEQ ID NO: 269 - protein, 31 aa, Artificial Sequence
  epitope peptide
CVETPIRNEWGSRSNDCSLLTEVETPIRNEC

SEQ ID NO: 270 - protein, 27 aa, Artificial Sequence
  epitope peptide
CLLTEVETPIRNEWGSCSLLTEVETPC

SEQ ID NO: 271 - protein, 29 aa, Artificial Sequence
  epitope peptide
CSLLTEVETPIRCVETPIRNEWGSRSNDC

SEQ ID NO: 272 - protein, 29 aa, Artificial Sequence
  epitope peptide
CSLLTEVETPIRCVETPIRNEWGSRSNDC

SEQ ID NO: 273 - protein, 31 aa, Artificial Sequence
  epitope peptides
CEVETPIRNEWGSRSNCSLLTEVETPIRNEC

SEQ ID NO: 274 - protein, 27 aa, Artificial Sequence
  epitope peptide
CSLLTEVETPCEVETPIRNEWGSRSNC

SEQ ID NO: 275 - protein, 33 aa, Artificial Sequence
  epitope peptide
CSLLTEVETPIRNEWGCEVETPIRNEWGSRSNC

SEQ ID NO: 276 - protein, 31 aa, Artificial Sequence
  epitope peptide
CSLLTEVETPIRNECEVETPIRNEWGSRSNC

SEQ ID NO: 277 - protein, 32 aa, Artificial Sequence
  epitope peptide
CSLLTEVETPIRNEWCTEVETPIRNEWGSRSC

SEQ ID NO: 278 - protein, 32 aa, Artificial Sequence
  epitope peptide
CSLLTEVETPIRNEWCLTEVETPIRNEWGSRC

SEQ ID NO: 279 - protein, 31 aa, Artificial Sequence
  epitope sequence
CSLLTEVETPIRNECVETPIRNEWGSRSNDC

SEQ ID NO: 280 - protein, 28 aa, Artificial Sequence
  epitope sequence
CSLLTEVETPICTEVETPIRNEWGSRSC

SEQ ID NO: 281 - protein, 26 aa, Artificial Sequence
  epitope peptide
CSLLTEVETCSLLTEVETPIRNEWGC

SEQ ID NO: 282 - protein, 15 aa, Artificial Sequence
  epitope peptide
CSCLCEVGMSCLCEC

SEQ ID NO: 283 - protein, 14 aa, Artificial Sequence
  epitope peptide
CSLLTEVGSLLTEV

SEQ ID NO: 284 - protein, 14 aa, Artificial Sequence
  epitope peptide
ASLLTEVGSLLTCV

SEQ ID NO: 285 - protein, 15 aa, Artificial Sequence
  epitope peptide
MSLLTEVGMSLLTCV

SEQ ID NO: 286 - protein, 15 aa, Artificial Sequence
  epitope peptide
CSLLTEVGMSLLTCV

SEQ ID NO: 287 - protein, 15 aa, Artificial Sequence
  epitope peptide
MSLLTEVGMSLLTEV

SEQ ID NO: 288 - protein, 15 aa, Artificial Sequence
  epitope peptide
CSCLCEVGMSLLTEV

SEQ ID NO: 289 - protein, 15 aa, Artificial Sequence
  epitope peptide
MSLCTEVGMSLCTEV

SEQ ID NO: 290 - protein, 14 aa, Artificial Sequence
  epitope peptide
CSLLTEVGSLLTCV

SEQ ID NO: 291 - protein, 15 aa, Artificial Sequence
  epitope peptide
MSLLTEVGMCLCTCV

SEQ ID NO: 292 - protein, 14 aa, Artificial Sequence
  epitope peptide
CSLLTEVGSLLTEC

SEQ ID NO: 293 - protein, 15 aa, Artificial Sequence
  epitope peptide
CSLLTEVGMSLLTEV

SEQ ID NO: 294 - protein, 15 aa, Artificial Sequence
  epitope peptide
MSCLCECGMSLLTEV

SEQ ID NO: 295 - protein, 15 aa, Artificial Sequence
  epitope peptide
MSLCTEVGMSCLTEV

SEQ ID NO: 296 - protein, 15 aa, Artificial Sequence
  epitope peptide
MSLLTEVGMCLLTEV

SEQ ID NO: 297 - protein, 15 aa, Artificial Sequence
  epitope peptide
CSLLTEVGMCLCTCV

SEQ ID NO: 298 - protein, 13 aa, Artificial Sequence
  epitope peptide
SLCTEVGSCLCEC

SEQ ID NO: 299 - protein, 13 aa, Artificial Sequence
  epitope peptide
SLLTEVGCLCTCV

SEQ ID NO: 300 - protein, 23 aa, Artificial Sequence
  epitope peptide
SLLTEVETKIRNEWGCRCNDSSD

SEQ ID NO: 301 - protein, 14 aa, Artificial Sequence
  epitope sequence
SLLCEVGCSLLTEC

SEQ ID NO: 302 - protein, 14 aa, Artificial Sequence
  epitope sequence
ASLLTEVGSCLTEV

SEQ ID NO: 303 - protein, 15 aa, Artificial Sequence
  epitope sequence
CSLLTEVGMCLLTEV

SEQ ID NO: 304 - protein, 15 aa, Artificial Sequence
  epitope peptide
MSLCTEVGMSLLCEV

SEQ ID NO: 305 - protein, 15 aa, Artificial Sequence
  epitope peptide
CSCLCEVGMSLLTEC

SEQ ID NO: 306 - protein, 15 aa, Artificial Sequence
  epitope peptide
CSLLTECGMSLLTCV

SEQ ID NO: 307 - protein, 13 aa, Artificial Sequence
  epitope peptide
SLCTEVGCLCTCV

SEQ ID NO: 308 - protein, 15 aa, Artificial Sequence
  epitope peptide
MSLCTEVGMCLCTCV

SEQ ID NO: 309 - protein, 15 aa, Artificial Sequence
  epitope peptide
CSLLTEVGMSLLCEV

SEQ ID NO: 310 - protein, 15 aa, Artificial Sequence
  epitope peptide
MSCLCECGMSLLTEC

SEQ ID NO: 311 - protein, 13 aa, Artificial Sequence
  epitope peptide
SLLTEVGCLLTEV

SEQ ID NO: 312 - protein, 23 aa, Artificial Sequence
  epitope peptide
TLLTEVETPIRNEWGCRCNDSSD

SEQ ID NO: 313 - protein, 23 aa, Artificial Sequence
  epitope peptide
SLLTEVETPIRNEWGCRCNDSGD

SEQ ID NO: 314 - protein, 13 aa, Artificial Sequence
  epitope peptide
SLLTEVGSLLCEV

SEQ ID NO: 315 - protein, 15 aa, Artificial Sequence
  epitope peptide
MCLCTCVGCSLLTEC

SEQ ID NO: 316 - protein, 15 aa, Artificial Sequence
  epitope peptide
MSLLTEVGCSLLTEV

SEQ ID NO: 317 - protein, 15 aa, Artificial Sequence
  epitope peptide
MSLLTEVGMSLCTEV

SEQ ID NO: 318 - protein, 23 aa, Artificial Sequence
  epitope peptide
SLLTEVETPIRNEWGCRCKDSSD

SEQ ID NO: 319 - protein, 13 aa, Artificial Sequence
  epitope peptide
SLLTECGSLLTCV

SEQ ID NO: 320 - protein, 13 aa, Artificial Sequence
  epitope peptide
SLLTEVGSLLTEV

SEQ ID NO: 321 - protein, 23 aa, Artificial Sequence
  epitope peptide
ALLTEVETPIRNEWGCRCNDSSD

SEQ ID NO: 322 - protein, 23 aa, Artificial Sequence
  epitope peptide
SKLTEVETPIRNEWGCRCNDSSD

SEQ ID NO: 323 - protein, 13 aa, Artificial Sequence
  epitope peptide
SLCTEVGSLLTCV

SEQ ID NO: 324 - protein, 13 aa, Artificial Sequence
  epitope peptide
SLCTEVGSLLTEV

SEQ ID NO: 325 - protein, 13 aa, Artificial Sequence
  epitope peptide
SLLTECGSLLTEV

SEQ ID NO: 326 - protein, 23 aa, Artificial Sequence
  epitope peptide
SLLTEVETPIRNEWGCRCNDSSD

SEQ ID NO: 327 - protein, 23 aa, Artificial Sequence
  epitope peptide
SLMTEVETPIRNEWGCRCNDSSD

SEQ ID NO: 328 - protein, 23 aa, Artificial Sequence
  epitope peptide
SLETEVETPIRNEWGCRCNDSSD

SEQ ID NO: 329 - protein, 13 aa, Artificial Sequence
  epitope peptide
SLLTEVGSCLCEC

SEQ ID NO: 330 - protein, 23 aa, Artificial Sequence
  epitope peptide
SLLTEVETPIRNEWGCRCNDYSD

SEQ ID NO: 331 - protein, 15 aa, Artificial Sequence
  epitope peptide
MSLLTECGMSLLTCV

SEQ ID NO: 332 - protein, 23 aa, Artificial Sequence
  epitope peptide
SALTEVETPIRNEWGCRCNDSSD

SEQ ID NO: 333 - protein, 13 aa, Artificial Sequence
  epitope peptide
SLLTCVGSLLTEC

SEQ ID NO: 334 - protein, 15 aa, Artificial Sequence
  epitope peptide
CSLLTEVGMSLCTEV

SEQ ID NO: 335 - protein, 15 aa, Artificial Sequence
  epitope peptide
CSCLCEVGCSLLTEC

SEQ ID NO: 336 - protein, 13 aa, Artificial Sequence
  epitope peptide
SLLCEVGSLLTEV

SEQ ID NO: 337 - protein, 23 aa, Artificial Sequence
  epitope peptide
SLLTEVETPIRNEWGCRCNYSSD

SEQ ID NO: 338 - protein, 23 aa, Artificial Sequence
  epitope peptide
SLLTEVETPIRNEWGCRCNDGSD

SEQ ID NO: 339 - protein, 15 aa, Artificial Sequence
  epitope peptide
MSLLTECGMSLLTEV

SEQ ID NO: 340 - protein, 15 aa, Artificial Sequence
  epitope peptide
MSCLCECGCSLLTEC

SEQ ID NO: 341 - protein, 14 aa, Artificial Sequence
  epitope peptide
CSLLTEVCSLLTEC

SEQ ID NO: 342 - protein, 23 aa, Artificial Sequence
  epitope peptide
SLLTEVETPIRNEWGCRCNSSSD

SEQ ID NO: 343 - protein, 15 aa, Artificial Sequence
  epitope peptide
MSLLTEVGMSLLTEC

SEQ ID NO: 344 - protein, 23 aa, Artificial Sequence
  epitope peptide
SMLTEVETPIRNEWGCRCNDSSD

SEQ ID NO: 345 - protein, 14 aa, Artificial Sequence
  epitope peptide
CSLLTEVGSCLTEV

SEQ ID NO: 346 - protein, 23 aa, Artificial Sequence
  epitope peptide
SLLMEVETPIRNEWGCRCNDSSD

SEQ ID NO: 347 - protein, 23 aa, Artificial Sequence
  epitope peptide
SLLTEVETPIRNEWICRCNDSSD

SEQ ID NO: 348 - protein, 14 aa, Artificial Sequence
  epitope peptide
SLLTECGCSLLTEV

SEQ ID NO: 349 - protein, 23 aa, Artificial Sequence
  epitope peptide
SLATEVETPIRNEWGCRCNDSSD

SEQ ID NO: 350 - protein, 23 aa, Artificial Sequence
  epitope peptide
SLLTEVETPIRNEWGCRCNDSND

SEQ ID NO: 351 - protein, 13 aa, Artificial Sequence
  epitope peptide
SLLCEVGSLLTEC

SEQ ID NO: 352 - protein, 23 aa, Artificial Sequence
  epitope peptide
SLQTEVETPIRNEWGCRCNDSSD

SEQ ID NO: 353 - protein, 14 aa, Artificial Sequence
  epitope peptide
SLLTEVGCSLLTEC

SEQ ID NO: 354 - protein, 14 aa, Artificial Sequence
  epitope peptide
SLLTEVGCSLLTEV

SEQ ID NO: 355 - protein, 14 aa, Artificial Sequence
  epitope peptide
SCLCECGCSLLTEV

SEQ ID NO: 356 - protein, 23 aa, Artificial Sequence
  epitope peptide
SLLTEVETPIRNEWGCRCNDSDD

SEQ ID NO: 357 - protein, 23 aa, Artificial Sequence
  epitope peptide
SLLTEVETPIPNEWGCRCNDSSD

SEQ ID NO: 358 - protein, 23 aa, Artificial Sequence
  epitope peptide
SFLTEVETPIRNEWGCRCNDSSD

SEQ ID NO: 359 - protein, 15 aa, Artificial Sequence
  epitope peptide
MSLLTEVGMSCLTEV

SEQ ID NO: 360 - protein, 15 aa, Artificial Sequence
  epitope peptide
CSLLTECGCSLLTEV

SEQ ID NO: 361 - protein, 14 aa, Artificial Sequence
  epitope peptide
SCLCECGCSLLTEC

SEQ ID NO: 362 - protein, 15 aa, Artificial Sequence
  epitope peptide
CSLLTECGMCLLTEV

SEQ ID NO: 363 - protein, 15 aa, Artificial Sequence
  epitope peptide
MSLLTECGCSLLTEV

SEQ ID NO: 364 - protein, 15 aa, Artificial Sequence
  epitope peptide
CSLLTEVGCSLLTEV

SEQ ID NO: 365 - protein, 15 aa, Artificial Sequence
  epitope peptide
CSLLTEVCMSLLTEC

SEQ ID NO: 366 - protein, 23 aa, Artificial Sequence
  epitope peptide
SLLTEVETPIRNEWWCRCNDSSD

SEQ ID NO: 367 - protein, 13 aa, Artificial Sequence
  epitope peptide
SLCTEVGSLLTEC

SEQ ID NO: 368 - protein, 15 aa, Artificial Sequence
  epitope peptide
SLLTEVETPIRNEWG

SEQ ID NO: 369 - protein, 23 aa, Artificial Sequence
  epitope peptide
SLLTEAETPIRNEWGCRCNDSSD

SEQ ID NO: 370 - protein, 23 aa, Artificial Sequence
  epitope peptide
SLLTEVETPIRNEWGERCNDSSD

SEQ ID NO: 371 - protein, 15 aa, Artificial Sequence
  epitope peptide
MSLCTEVGMSLLTEV

SEQ ID NO: 372 - protein, 15 aa, Artificial Sequence
  epitope peptide
CSLLTEVGMSCLTEV

SEQ ID NO: 373 - protein, 15 aa, Artificial Sequence
  epitope peptide
CSLLTECGMSLLTEV

SEQ ID NO: 374 - protein, 14 aa, Artificial Sequence
  epitope peptide
SLLTECGCSLLTEC

SEQ ID NO: 375 - protein, 23 aa, Artificial Sequence
  epitope peptide
SLLTEVETPIRNEWGCRVNDSSD

SEQ ID NO: 376 - protein, 15 aa, Artificial Sequence
  epitope peptide
CSLLTECGMSLLTEC

SEQ ID NO: 377 - protein, 23 aa, Artificial Sequence
  epitope peptide
SLKTEVETPIRNEWGCRCNDSSD

SEQ ID NO: 378 - protein, 13 aa, Artificial Sequence
  epitope peptide
SLLTECGSLLTEC

SEQ ID NO: 379 - protein, 14 aa, Artificial Sequence
  epitope peptide
SLCTEVGCSCLCEV

SEQ ID NO: 380 - protein, 23 aa, Artificial Sequence
  epitope peptide
SLLTEVETPIRNTWGCRCNDSSD

SEQ ID NO: 381 - protein, 23 aa, Artificial Sequence
  epitope peptide
SLLQEVETPIRNEWGCRCNDSSD

SEQ ID NO: 382 - protein, 14 aa, Artificial Sequence
  epitope peptide
CSLLTECGSLLTEV

SEQ ID NO: 383 - protein, 15 aa, Artificial Sequence
  epitope peptide
CSLLTEVGCSLLTEC

SEQ ID NO: 384 - protein, 23 aa, Artificial Sequence
  epitope peptide
SLLTEVETPIRNEYGCRCNDSSD

SEQ ID NO: 385 - protein, 14 aa, Artificial Sequence
  epitope peptide
CSLLTEVGCLCTCV

SEQ ID NO: 386 - protein, 23 aa, Artificial Sequence
  epitope peptide
SLLTEVETPIRNEVGCRCNDSSD

SEQ ID NO: 387 - protein, 23 aa, Artificial Sequence
  epitope peptide
SLLTEVETPIRTEWGCRCNDSSD

SEQ ID NO: 388 - protein, 14 aa, Artificial Sequence
  epitope peptide
CSLLTEVGCLLTEV

SEQ ID NO: 389 - protein, 23 aa, Artificial Sequence
  epitope peptide
SLLTEVETPYRNEWGCRCNDSSD

SEQ ID NO: 390 - protein, 13 aa, Artificial Sequence
  epitope peptide
CLLTEVGSLLTEV

SEQ ID NO: 391 - protein, 23 aa, Artificial Sequence
  epitope peptide
SNLTEVETPIRNEWGCRCNDSSD

SEQ ID NO: 392 - protein, 23 aa, Artificial Sequence
  epitope peptide
SLLTEVETPKRNEWGCRCNDSSD

SEQ ID NO: 393 - protein, 23 aa, Artificial Sequence
  epitope peptide
SLLTEVETPIRNEWGCRCNLSSD

SEQ ID NO: 394 - protein, 23 aa, Artificial Sequence
  epitope peptide
SLLTEVETPIRNEWGCRCNMSSD

SEQ ID NO: 395 - protein, 23 aa, Artificial Sequence
  epitope peptide
SLLTEVETPIRNEWGCRCNNSSD

SEQ ID NO: 396 - protein, 23 aa, Artificial Sequence
  epitope peptide
SLLTEVETPIRNEWGCRCNPSSD

SEQ ID NO: 397 - protein, 23 aa, Artificial Sequence
  epitope peptide
SLLTEVETPIRNEWGCRCNQSSD

SEQ ID NO: 398 - protein, 23 aa, Artificial Sequence
  epitope peptide
SLLTEVETPIRNEWGCRCNRSSD

SEQ ID NO: 399 - protein, 23 aa, Artificial Sequence
  epitope peptide
SLLTEVETPIRNEWGCRCNTSSD

SEQ ID NO: 400 - protein, 23 aa, Artificial Sequence
  epitope peptide
SLLTEVETPIRNEWGCRCNVSSD

SEQ ID NO: 401 - protein, 23 aa, Artificial Sequence
  epitope peptide
SLLTEVETPIRNEWGCRCNWSSD

SEQ ID NO: 402 - protein, 23 aa, Artificial Sequence
  epitope peptide
SLLTEVETPIRNEWGCRCNDASD

SEQ ID NO: 403 - protein, 23 aa, Artificial Sequence
  epitope peptide
SLLTEVETPIRNEWGCRCNDCSD

SEQ ID NO: 404 - protein, 23 aa, Artificial Sequence
  epitope peptide
SLLTEVETPIRNEWGCRCNDDSD

SEQ ID NO: 405 - protein, 23 aa, Artificial Sequence
  epitope peptide
SLLTEVETPIRNEWGCRCNDESD

SEQ ID NO: 406 - protein, 23 aa, Artificial Sequence
  epitope peptide
SLLTEVETPIRNEWGCRCNDFSD

SEQ ID NO: 407 - protein, 23 aa, Artificial Sequence
  epitope peptide
SLLTEVETPIRNEWGCRCNDHSD

SEQ ID NO: 408 - protein, 23 aa, Artificial Sequence
  epitope peptide
SLLTEVETPIRNEWGCRCNDISD

SEQ ID NO: 409 - protein, 23 aa, Artificial Sequence
  epitope peptide
SLLTEVETPIRNEWGCRCNDKSD

SEQ ID NO: 410 - protein, 23 aa, Artificial Sequence
  epitope peptide
SLLTEVETPIRNEWGCRCNDLSD

SEQ ID NO: 411 - protein, 23 aa, Artificial Sequence
  epitope peptide
SLLTEVETPIRNEWGCRCNDMSD

SEQ ID NO: 412 - protein, 23 aa, Artificial Sequence
  epitope peptide
SLLTEVETPIRNEWGCRCNDNSD

SEQ ID NO: 413 - protein, 23 aa, Artificial Sequence
  epitope peptide
SLLTEVETPIRNEWGCRCNDPSD

SEQ ID NO: 414 - protein, 23 aa, Artificial Sequence
  epitope peptide
SLLTEVETPIRNEWGCRCNDQSD

SEQ ID NO: 415 - protein, 23 aa, Artificial Sequence
  epitope peptide
SLLTEVETPIRNEWGCRCNDRSD

SEQ ID NO: 416 - protein, 23 aa, Artificial Sequence
  epitope peptide
SLLTEVETPIRNEWGCRCNDTSD

SEQ ID NO: 417 - protein, 23 aa, Artificial Sequence
  epitope peptide
SLLTEVETPIRNEWGCRCNDVSD

SEQ ID NO: 418 - protein, 23 aa, Artificial Sequence
  epitope peptide
SLLTEVETPIRNEWGCRCNDWSD

SEQ ID NO: 419 - protein, 23 aa, Artificial Sequence
  epitope peptide
SLLTEVETPIRNEWGCRCNDSAD

SEQ ID NO: 420 - protein, 23 aa, Artificial Sequence
  epitope peptide
SLLTEVETPIRNEWGCRCNDSCD

SEQ ID NO: 421 - protein, 23 aa, Artificial Sequence
  epitope peptide
SLLTEVETPIRNEWGCRCNDSED

SEQ ID NO: 422 - protein, 23 aa, Artificial Sequence
  epitope peptide
SLLTEVETPIRNEWGCRCNDSFD

SEQ ID NO: 423 - protein, 23 aa, Artificial Sequence
  epitope peptide
SLLTEVETPIRNEWGCRCNDSHD

SEQ ID NO: 424 - protein, 23 aa, Artificial Sequence
  epitope peptide
SLLTEVETPIRNEWGCRCNDSID

SEQ ID NO: 425 - protein, 23 aa, Artificial Sequence
  epitope peptide
SLLTEVETPIRNEWGCRCNDSKD

SEQ ID NO: 426 - protein, 23 aa, Artificial Sequence
  epitope peptide
SLLTEVETPIRNEWGCRCNDSLD

SEQ ID NO: 427 - protein, 23 aa, Artificial Sequence
  epitope peptide
SLLTEVETPIRNEWGCRCNDSMD

SEQ ID NO: 428 - protein, 23 aa, Artificial Sequence
  epitope peptide
SLLTEVETPIRNEWGCRCNDSPD

SEQ ID NO: 429 - protein, 23 aa, Artificial Sequence
  epitope peptide
SLLTEVETPIRNEWGCRCNDSQD

SEQ ID NO: 430 - protein, 23 aa, Artificial Sequence
  epitope peptide
SLLTEVETPIRNEWGCRCNDSRD

SEQ ID NO: 431 - protein, 23 aa, Artificial Sequence
  epitope peptide
SLLTEVETPIRNEWGCRCNDSTD

SEQ ID NO: 432 - protein, 23 aa, Artificial Sequence
  epitope peptide
SLLTEVETPIRNEWGCRCNDSVD

SEQ ID NO: 433 - protein, 23 aa, Artificial Sequence
  epitope peptide
SLLTEVETPIRNEWGCRCNDSWD

SEQ ID NO: 434 - protein, 23 aa, Artificial Sequence
  epitope peptide
SLLTEVETPIRNEWGCRCNDSYD

SEQ ID NO: 435 - protein, 9 aa, Artificial Sequence
  epitope peptide
SLLTEVETP

SEQ ID NO: 436 - protein, 10 aa, Artificial Sequence
  epitope peptide
SLLTEVETPI

SEQ ID NO: 437 - protein, 11 aa, Artificial Sequence
  epitope peptide
SLLTEVETPIR

SEQ ID NO: 438 - protein, 12 aa, Artificial Sequence
  epitope peptide
SLLTEVETPIRN

SEQ ID NO: 439 - protein, 13 aa, Artificial Sequence
  epitope peptide
SLLTEVETPIRNE

SEQ ID NO: 440 - protein, 14 aa, Artificial Sequence
  epitope peptide
SLLTEVETPIRNEW

SEQ ID NO: 441 - skipped

SEQ ID NO: 442 - protein, 16 aa, Artificial Sequence
  epitope peptide
SLLTEVETPIRNEWGC

SEQ ID NO: 443 - protein, 17 aa, Artificial Sequence
  epitope peptide
SLLTEVETPIRNEWGCR

SEQ ID NO: 444 - protein, 18 aa, Artificial Sequence
  epitope peptide
SLLTEVETPIRNEWGCRC

SEQ ID NO: 445 - protein, 19 aa, Artificial Sequence
  epitope peptide
SLLTEVETPIRNEWGCRCN

SEQ ID NO: 446 - protein, 20 aa, Artificial Sequence
  epitope peptide
SLLTEVETPIRNEWGCRCND

SEQ ID NO: 447 - protein, 21 aa, Artificial Sequence
  epitope peptide
SLLTEVETPIRNEWGCRCNDS

SEQ ID NO: 448 - protein, 22 aa, Artificial Sequence
  epitope peptide
SLLTEVETPIRNEWGCRCNDSS

SEQ ID NO: 449 - protein, 23 aa, Artificial Sequence
  epitope peptide
SLNTEVETPIRNEWGCRCNDSSD

SEQ ID NO: 450 - protein, 23 aa, Artificial Sequence
  epitope peptide
SLLTEVEHPIRNEWGCRCNDSSD

SEQ ID NO: 451 - protein, 15 aa, Artificial Sequence
  epitope peptide
CSLLTEVGMSLLTEC

SEQ ID NO: 452 - protein, 13 aa, Artificial Sequence
  epitope peptide
SLLTEVGSLLTEC

SEQ ID NO: 453 - protein, 23 aa, Artificial Sequence
  epitope peptide
SLLTEVETPIRNEAGCRCNDSSD

SEQ ID NO: 454 - protein, 23 aa, Artificial Sequence
  epitope peptide
SLLTEVETPIMNEWGCRCNDSSD

SEQ ID NO: 455 - protein, 13 aa, Artificial Sequence
  epitope peptide
CLCTCVGSLLTEC

SEQ ID NO: 456 - protein, 15 aa, Artificial Sequence
  epitope peptide
CSLLTECGMSLLCEV

SEQ ID NO: 457 - protein, 23 aa, Artificial Sequence
  epitope peptide
SLLTEVETPMRNEWGCRCNDSSD

SEQ ID NO: 458 - protein, 14 aa, Artificial Sequence
  epitope peptide
CSLLTECGSCLTEV

SEQ ID NO: 459 - protein, 23 aa, Artificial Sequence
  epitope peptide
SLITEVETPIRNEWGCRCNDSSD

SEQ ID NO: 460 - protein, 15 aa, Artificial Sequence
  epitope peptide
MSLLTECGMSLLCEV

SEQ ID NO: 461 - protein, 23 aa, Artificial Sequence
  epitope peptide
SLLTEVETPLRNEWGCRCNDSSD

SEQ ID NO: 462 - protein, 13 aa, Artificial Sequence
  epitope peptide
SLLTECGCLLTEV

SEQ ID NO: 463 - protein, 14 aa, Artificial Sequence
  epitope peptide
CSLLTECGSLLTCV

SEQ ID NO: 464 - protein, 13 aa, Artificial Sequence
  epitope peptide
SLLTEVGSLCTEV

SEQ ID NO: 465 - protein, 23 aa, Artificial Sequence
  epitope peptide
SLLTEVETPIRNEWGCRCNKSSD

SEQ ID NO: 466 - protein, 14 aa, Artificial Sequence
  epitope peptide
SCLTEVGCSLLTEV

SEQ ID NO: 467 - protein, 23 aa, Artificial Sequence
  epitope peptide
SLLTEVENPIRNEWGCRCNDSSD

SEQ ID NO: 468 - protein, 13 aa, Artificial Sequence
  epitope peptide
SCLCECGSLLTEC

SEQ ID NO: 469 - protein, 15 aa, Artificial Sequence
  epitope peptide
MSLLTECGMSLLTEC

SEQ ID NO: 470 - protein, 15 aa, Artificial Sequence
  epitope peptide
MSLLTEVGCSLLTEC

SEQ ID NO: 471 - protein, 23 aa, Artificial Sequence
  epitope peptide
SLLTEEETPIRNEWGCRCNDSSD

SEQ ID NO: 472 - protein, 13 aa, Artificial Sequence
  epitope peptide
SLLTECGSLCTEV

SEQ ID NO: 473 - protein, 23 aa, Artificial Sequence
  epitope peptide
SLSTEVETPIRNEWGCRCNDSSD

SEQ ID NO: 474 - protein, 23 aa, Artificial Sequence
  epitope peptide
SLLTECETPIRNEWGCRCNDSSD

SEQ ID NO: 475 - protein, 15 aa, Artificial Sequence
  epitope peptide
MSLLTECGMSLCTEV

SEQ ID NO: 476 - protein, 15 aa, Artificial Sequence
  epitope peptide
CSLLTEVGCSCLCEV

SEQ ID NO: 477 - protein, 13 aa, Artificial Sequence
  epitope peptide
SLLTECGSLLCEV

SEQ ID NO: 478 - protein, 23 aa, Artificial Sequence
  epitope peptide
SLTTEVETPIRNEWGCRCNDSSD

SEQ ID NO: 479 - protein, 23 aa, Artificial Sequence
  epitope peptide
SLLTEDETPIRNEWGCRCNDSSD

SEQ ID NO: 480 - protein, 13 aa, Artificial Sequence
  epitope peptide
SLLTECGCLCTCV

SEQ ID NO: 481 - protein, 15 aa, Artificial Sequence
  epitope peptide
CSLLTECGMSLCTEV

SEQ ID NO: 482 - protein, 13 aa, Artificial Sequence
  epitope peptide
CLCTCVGSLLTEV

SEQ ID NO: 483 - protein, 15 aa, Artificial Sequence
  epitope peptide
CSLLTECGCSLLTEC

SEQ ID NO: 484 - protein, 23 aa, Artificial Sequence
  epitope peptide
SLVTEVETPIRNEWGCRCNDSSD

SEQ ID NO: 485 - protein, 15 aa, Artificial Sequence
  epitope peptide
CSLLTECGMCLCTCV

SEQ ID NO: 486 - protein, 23 aa, Artificial Sequence
  epitope peptide
SLFTEVETPIRNEWGCRCNDSSD

SEQ ID NO: 487 - protein, 23 aa, Artificial Sequence
  epitope peptide
SLLTNVETPIRNEWGCRCNDSSD

SEQ ID NO: 488 - protein, 23 aa, Artificial Sequence
  epitope peptide
SLLTEVETPIHNEWGCRCNDSSD

SEQ ID NO: 489 - protein, 15 aa, Artificial Sequence
  epitope peptide
MSLLTECGMCLLTEV

SEQ ID NO: 490 - protein, 23 aa, Artificial Sequence
  epitope peptide
SVLTEVETPIRNEWGCRCNDSSD

SEQ ID NO: 491 - protein, 23 aa, Artificial Sequence
  epitope peptide
SLLTEVETLIRNEWGCRCNDSSD

SEQ ID NO: 492 - protein, 15 aa, Artificial Sequence
  epitope peptide
MSLLTECGMCLCTCV

SEQ ID NO: 493 - protein, 23 aa, Artificial Sequence
  epitope peptide
SLLTEVETMIRNEWGCRCNDSSD

SEQ ID NO: 494 - protein, 23 aa, Artificial Sequence
  epitope peptide
SLLTEQETPIRNEWGCRCNDSSD

SEQ ID NO: 495 - protein, 23 aa, Artificial Sequence
  epitope peptide
SLLTEVETPGRNEWGCRCNDSSD

SEQ ID NO: 496 - protein, 13 aa, Artificial Sequence
  epitope peptide
SCLTEVGSLLCEV

SEQ ID NO: 497 - protein, 13 aa, Artificial Sequence
  epitope peptide
SLLTECGSCLCEC

SEQ ID NO: 498 - protein, 23 aa, Artificial Sequence
  epitope peptide
SLLTEMETPIRNEWGCRCNDSSD

SEQ ID NO: 499 - protein, 15 aa, Artificial Sequence
  epitope peptide
CSLLTEVGMSCLCEC

SEQ ID NO: 500 - protein, 13 aa, Artificial Sequence
  epitope peptide
SCLTEVGSLLTEV

SEQ ID NO: 501 - protein, 23 aa, Artificial Sequence
  epitope peptide
SLLTEVETPIRNEWGCCCNDSSD

SEQ ID NO: 502 - protein, 14 aa, Artificial Sequence
  epitope peptide
CSCLCEVGSLLTEC

SEQ ID NO: 503 - protein, 23 aa, Artificial Sequence
  epitope peptide
SLLTEVETPIRNEWGCWCNDSSD

SEQ ID NO: 504 - protein, 23 aa, Artificial Sequence
  epitope peptide
SLLTEVETPIRNEWGFRCNDSSD

SEQ ID NO: 505 - protein, 23 aa, Artificial Sequence
  epitope peptide
SLLTEKETPIRNEWGCRCNDSSD

SEQ ID NO: 506 - protein, 13 aa, Artificial Sequence
  epitope peptide
SLCTEVGSLLCEV

SEQ ID NO: 507 - protein, 23 aa, Artificial Sequence
  epitope peptide
SLCTEVETPIRNEWGCRCNDSSD

SEQ ID NO: 508 - protein, 15 aa, Artificial Sequence
  epitope peptide
MSLCTEVGCSLLTEV

SEQ ID NO: 509 - protein, 23 aa, Artificial Sequence
  epitope peptide
SLLTEVETPIYNEWGCRCNDSSD

SEQ ID NO: 510 - protein, 23 aa, Artificial Sequence
  epitope peptide
SLRTEVETPIRNEWGCRCNDSSD

SEQ ID NO: 511 - protein, 14 aa, Artificial Sequence
  epitope peptide
SLLCEVGCSLLTEV

SEQ ID NO: 512 - protein, 23 aa, Artificial Sequence
  epitope peptide
SLLTEVETPIRNQWGCRCNDSSD

SEQ ID NO: 513 - protein, 15 aa, Artificial Sequence
  epitope peptide
MCLLTEVGMSLLTEV

SEQ ID NO: 514 - protein, 23 aa, Artificial Sequence
  epitope peptide
SLLTEGETPIRNEWGCRCNDSSD

SEQ ID NO: 515 - protein, 23 aa, Artificial Sequence
  epitope peptide
SLLTEWETPIRNEWGCRCNDSSD

SEQ ID NO: 516 - protein, 23 aa, Artificial Sequence
  epitope peptide
SLLTEVETPIRNEWGCRCPDSSD

SEQ ID NO: 517 - protein, 23 aa, Artificial Sequence
  epitope peptide
SLLTEVETPIRNEMGCRCNDSSD

SEQ ID NO: 518 - protein, 23 aa, Artificial Sequence
  epitope peptide
SYLTEVETPIRNEWGCRCNDSSD

SEQ ID NO: 519 - protein, 23 aa, Artificial Sequence
  epitope peptide
SLLTEVETPIRNEWGCRSNDSSD

SEQ ID NO: 520 - protein, 23 aa, Artificial Sequence
  epitope peptide
VLLTEVETPIRNEWGCRCNDSSD

SEQ ID NO: 521 - protein, 23 aa, Artificial Sequence
  epitope peptide
SLLTAVETPIRNEWGCRCNDSSD

SEQ ID NO: 522 - protein, 23 aa, Artificial Sequence
  epitope peptide
SLLTMVETPIRNEWGCRCNDSSD

SEQ ID NO: 523 - protein, 23 aa, Artificial Sequence
  epitope peptide
SLLTEFETPIRNEWGCRCNDSSD

SEQ ID NO: 524 - protein, 23 aa, Artificial Sequence
  epitope peptide
SLLTEVETPIDNEWGCRCNDSSD

SEQ ID NO: 525 - protein, 14 aa, Artificial Sequence
  epitope peptide
SLLTEVGCSCLCEV

SEQ ID NO: 526 - protein, 15 aa, Artificial Sequence
  epitope peptide
MSLLTECGMSCLCEC

SEQ ID NO: 527 - protein, 23 aa, Artificial Sequence
  epitope peptide
SLLTEVEQPIRNEWGCRCNDSSD

SEQ ID NO: 528 - protein, 15 aa, Artificial Sequence
  epitope peptide
MSLLTCVGCSLLTEV

SEQ ID NO: 529 - protein, 23 aa, Artificial Sequence
  epitope peptide
SLLTEVETNIRNEWGCRCNDSSD

SEQ ID NO: 530 - protein, 23 aa, Artificial Sequence
  epitope peptide
SLLTESETPIRNEWGCRCNDSSD

SEQ ID NO: 531 - protein, 15 aa, Artificial Sequence
  epitope peptide
MSLCTEVGMSLLTEC

SEQ ID NO: 532 - protein, 15 aa, Artificial Sequence
  epitope peptide
MSCLTEVGMSLLTEV

SEQ ID NO: 533 - protein, 14 aa, Artificial Sequence
  epitope peptide
CSLLTEVGSCLCEC

SEQ ID NO: 534 - protein, 23 aa, Artificial Sequence
  epitope peptide
SLLTEVEKPIRNEWGCRCNDSSD

SEQ ID NO: 535 - protein, 23 aa, Artificial Sequence
  epitope peptide
SLLTEVETPIRNEWGCRCNFSSD

SEQ ID NO: 536 - protein, 15 aa, Artificial Sequence
  epitope peptide
MCLCTCVGCSLLTEV

SEQ ID NO: 537 - protein, 23 aa, Artificial Sequence
  epitope peptide
SLLTEVEPPIRNEWGCRCNDSSD

SEQ ID NO: 538 - protein, 23 aa, Artificial Sequence
  epitope peptide
LLLTEVETPIRNEWGCRCNDSSD

SEQ ID NO: 539 - protein, 23 aa, Artificial Sequence
  epitope peptide
SLLTEYETPIRNEWGCRCNDSSD

SEQ ID NO: 540 - protein, 23 aa, Artificial Sequence
  epitope peptide
SLLTEHETPIRNEWGCRCNDSSD

SEQ ID NO: 541 - protein, 23 aa, Artificial Sequence
  epitope peptide
SLLTEVETPIRNEWKCRCNDSSD

SEQ ID NO: 542 - protein, 15 aa, Artificial Sequence
  epitope peptide
MSLCTEVGMSLLTCV

SEQ ID NO: 543 - protein, 15 aa, Artificial Sequence
  epitope peptide
MSLLTCVGMSLLTEV

SEQ ID NO: 544 - protein, 23 aa, Artificial Sequence
  epitope peptide
SLLTEVETPIRNEWGCRCRDSSD

SEQ ID NO: 545 - protein, 23 aa, Artificial Sequence
  epitope peptide
SLLTEVSTPIRNEWGCRCNDSSD

SEQ ID NO: 546 - protein, 23 aa, Artificial Sequence
  epitope peptide
SLLTEVETPIRNRWGCRCNDSSD

SEQ ID NO: 547 - protein, 23 aa, Artificial Sequence
  epitope peptide
SLLTETETPIRNEWGCRCNDSSD

SEQ ID NO: 548 - protein, 14 aa, Artificial Sequence
  epitope peptide
CSLLTECGSLCTEV

SEQ ID NO: 549 - protein, 23 aa, Artificial Sequence
  epitope peptide
SLLTEVETFIRNEWGCRCNDSSD

SEQ ID NO: 550 - protein, 23 aa, Artificial Sequence
  epitope peptide
SLLTENETPIRNEWGCRCNDSSD

SEQ ID NO: 551 - protein, 23 aa, Artificial Sequence
  epitope peptide
SLLTEVATPIRNEWGCRCNDSSD

SEQ ID NO: 552 - protein, 23 aa, Artificial Sequence
  epitope peptide
SLLTEVETPIRNEWGCYCNDSSD

SEQ ID NO: 553 - protein, 23 aa, Artificial Sequence
  epitope peptide
SLLTEVTTPIRNEWGCRCNDSSD

SEQ ID NO: 554 - protein, 13 aa, Artificial Sequence
  epitope peptide
CLLTEVGSLLTCV

SEQ ID NO: 555 - protein, 23 aa, Artificial Sequence
  epitope peptide
SLLTEVETPIRNEWGCRCWDSSD

SEQ ID NO: 556 - protein, 23 aa, Artificial Sequence
  epitope peptide
SLLTELETPIRNEWGCRCNDSSD

SEQ ID NO: 557 - protein, 15 aa, Artificial Sequence
  epitope peptide
MSCLTEVGCSLLTEV

SEQ ID NO: 558 - protein, 15 aa, Artificial Sequence
  epitope peptide
CSLLTECGMSCLCEC

SEQ ID NO: 559 - protein, 23 aa, Artificial Sequence
  epitope peptide
SLLTEVETAIRNEWGCRCNDSSD

SEQ ID NO: 560 - protein, 23 aa, Artificial Sequence
  epitope peptide
SLLTEVETPIRNEWGCRCFDSSD

SEQ ID NO: 561 - protein, 23 aa, Artificial Sequence
  epitope peptide
SCLTEVETPIRNEWGCRCNDSSD

SEQ ID NO: 562 - protein, 23 aa, Artificial Sequence
  epitope peptide
SLLTEVETPIRWEWGCRCNDSSD

SEQ ID NO: 563 - protein, 23 aa, Artificial Sequence
  epitope peptide
SLLTEVETPIRNEWGGRCNDSSD

SEQ ID NO: 564 - protein, 23 aa, Artificial Sequence
  epitope peptide
SLLTEVELPIRNEWGCRCNDSSD

SEQ ID NO: 565 - protein, 23 aa, Artificial Sequence
  epitope peptide
SLLTEVETPIRVEWGCRCNDSSD

SEQ ID NO: 566 - protein, 23 aa, Artificial Sequence
  epitope peptide
SLLTEVCTPIRNEWGCRCNDSSD

SEQ ID NO: 567 - protein, 14 aa, Artificial Sequence
  epitope peptide
SLLTECGCSCLCEV

SEQ ID NO: 568 - protein, 23 aa, Artificial Sequence
  epitope peptide
SLLTEVETPIRNEWGCRCQDSSD

SEQ ID NO: 569 - protein, 23 aa, Artificial Sequence
  epitope peptide
SLLTEVETPIRNEWLCRCNDSSD

SEQ ID NO: 570 - protein, 15 aa, Artificial Sequence
  epitope peptide
MCLLTEVGCSLLTEV

SEQ ID NO: 571 - protein, 23 aa, Artificial Sequence
  epitope peptide
SLLTEVETPIRNLWGCRCNDSSD

SEQ ID NO: 572 - protein, 23 aa, Artificial Sequence
  epitope peptide
SLLTEVETPIRNEKGCRCNDSSD

SEQ ID NO: 573 - protein, 23 aa, Artificial Sequence
  epitope peptide
SLLTEVETPIRNEWGCRTNDSSD

SEQ ID NO: 574 - protein, 13 aa, Artificial Sequence
  epitope peptide
CLLTEVGSLLTEC

SEQ ID NO: 575 - protein, 23 aa, Artificial Sequence
  epitope peptide
SLLTEVRTPIRNEWGCRCNDSSD

SEQ ID NO: 576 - protein, 23 aa, Artificial Sequence
  epitope peptide
SLLTEVETPIFNEWGCRCNDSSD

SEQ ID NO: 577 - protein, 23 aa, Artificial Sequence
  epitope peptide
SLLTEVETPIRNIWGCRCNDSSD

SEQ ID NO: 578 - protein, 23 aa, Artificial Sequence
  epitope peptide
SLLTERETPIRNEWGCRCNDSSD

SEQ ID NO: 579 - protein, 23 aa, Artificial Sequence
  epitope peptide
SLLTEVETPIRNEWGCRWNDSSD

SEQ ID NO: 580 - protein, 14 aa, Artificial Sequence
  epitope peptide
SLCTEVGCSLLTEV

SEQ ID NO: 581 - protein, 23 aa, Artificial Sequence
  epitope peptide
SLLTEVETYIRNEWGCRCNDSSD

SEQ ID NO: 582 - protein, 23 aa, Artificial Sequence
  epitope peptide
SLLTEVETPIRAEWGCRCNDSSD

SEQ ID NO: 583 - protein, 23 aa, Artificial Sequence
  epitope peptide
SLLTEVWTPIRNEWGCRCNDSSD

SEQ ID NO: 584 - protein, 23 aa, Artificial Sequence
  epitope peptide
SLLTEVETPIRNEWGCRRNDSSD

SEQ ID NO: 585 - protein, 23 aa, Artificial Sequence
  epitope peptide
SLLTEVETPIRLEWGCRCNDSSD

SEQ ID NO: 586 - protein, 23 aa, Artificial Sequence
  epitope peptide
SLLTEVETPIRNEWGCRCNISSD

SEQ ID NO: 587 - protein, 23 aa, Artificial Sequence
  epitope peptide
SLLTEVETPIRCEWGCRCNDSSD

SEQ ID NO: 588 - protein, 23 aa, Artificial Sequence
  epitope peptide
SLLTEVETPIRNEWGCRCNCSSD

SEQ ID NO: 589 - protein, 15 aa, Artificial Sequence
  epitope peptide
CSLLTECGMSCLTEV

SEQ ID NO: 590 - protein, 23 aa, Artificial Sequence
  epitope peptide
SLLTEVEMPIRNEWGCRCNDSSD

SEQ ID NO: 591 - protein, 23 aa, Artificial Sequence
  epitope peptide
SLLTEVETPHRNEWGCRCNDSSD

SEQ ID NO: 592 - protein, 15 aa, Artificial Sequence
  epitope peptide
MSLCTEVGCSLLTEC

SEQ ID NO: 593 - protein, 23 aa, Artificial Sequence
  epitope peptide
SLLTEVEIPIRNEWGCRCNDSSD

SEQ ID NO: 594 - protein, 23 aa, Artificial Sequence
  epitope peptide
SLLTEVQTPIRNEWGCRCNDSSD

SEQ ID NO: 595 - protein, 23 aa, Artificial Sequence
  epitope peptide
SLLTEVETPIRNEWGWRCNDSSD

SEQ ID NO: 596 - protein, 23 aa, Artificial Sequence
  epitope peptide
SLLTEVETPIRNEWFCRCNDSSD

SEQ ID NO: 597 - protein, 23 aa, Artificial Sequence
  epitope peptide
SLLTEVETGIRNEWGCRCNDSSD

SEQ ID NO: 598 - protein, 23 aa, Artificial Sequence
  epitope peptide
SLLTEVETPIRNEWGCRKNDSSD

SEQ ID NO: 599 - protein, 23 aa, Artificial Sequence
  epitope peptide
SLLTEVERPIRNEWGCRCNDSSD

SEQ ID NO: 600 - protein, 23 aa, Artificial Sequence
  epitope peptide
SLLTEVETPIRNEWGLRCNDSSD

SEQ ID NO: 601 - protein, 13 aa, Artificial Sequence
  epitope peptide
SLLTECGSCLTEV

SEQ ID NO: 602 - protein, 23 aa, Artificial Sequence
  epitope peptide
SLLTEVETEIRNEWGCRCNDSSD

SEQ ID NO: 603 - protein, 23 aa, Artificial Sequence
  epitope peptide
SLLTEVETPIRNEWGCRCNGSSD

SEQ ID NO: 604 - protein, 13 aa, Artificial Sequence
  epitope peptide
SLCTEVGSCLTEV

SEQ ID NO: 605 - protein, 23 aa, Artificial Sequence
  epitope peptide
SLLTEVETPIRNMWGCRCNDSSD

SEQ ID NO: 606 - protein, 23 aa, Artificial Sequence
  epitope peptide
SLLTEVETQIRNEWGCRCNDSSD

SEQ ID NO: 607 - protein, 23 aa, Artificial Sequence
  epitope peptide
SLLTEVESPIRNEWGCRCNDSSD

SEQ ID NO: 608 - protein, 23 aa, Artificial Sequence
  epitope peptide
SLLTEIETPIRNEWGCRCNDSSD

SEQ ID NO: 609 - protein, 23 aa, Artificial Sequence
  epitope peptide
SLLTEVETHIRNEWGCRCNDSSD

SEQ ID NO: 610 - protein, 23 aa, Artificial Sequence
  epitope peptide
SLLTEVETDIRNEWGCRCNDSSD

SEQ ID NO: 611 - protein, 23 aa, Artificial Sequence
  epitope peptide
SLLTEVETRIRNEWGCRCNDSSD

SEQ ID NO: 612 - protein, 23 aa, Artificial Sequence
  epitope peptide
SLLTEVETPIRNEWGCRCIDSSD

SEQ ID NO: 613 - protein, 23 aa, Artificial Sequence
  epitope peptide
SLLTEVETPIRNEWGCRCNHSSD

SEQ ID NO: 614 - protein, 23 aa, Artificial Sequence
  epitope peptide
SLLTEVETVIRNEWGCRCNDSSD

SEQ ID NO: 615 - protein, 23 aa, Artificial Sequence
  epitope peptide
SLLTEVETPIRNEWGCDCNDSSD

SEQ ID NO: 616 - protein, 23 aa, Artificial Sequence
  epitope peptide
SLLTEVETPIRNPWGCRCNDSSD

SEQ ID NO: 617 - protein, 23 aa, Artificial Sequence
  epitope peptide
SLLTEVETPIRNSWGCRCNDSSD

SEQ ID NO: 618 - protein, 23 aa, Artificial Sequence
  epitope peptide
SLLTEVETPIRNEWGCRCLDSSD

SEQ ID NO: 619 - protein, 23 aa, Artificial Sequence
  epitope peptide
SLLTEVETPIRNEWGCRCNASSD

SEQ ID NO: 620 - protein, 23 aa, Artificial Sequence
  epitope peptide
SLLTEVETPIRFEWGCRCNDSSD

SEQ ID NO: 621 - protein, 23 aa, Artificial Sequence
  epitope peptide
SLLTEVEFPIRNEWGCRCNDSSD

SEQ ID NO: 622 - protein, 23 aa, Artificial Sequence
  epitope peptide
SLLTEVETPIRMEWGCRCNDSSD

SEQ ID NO: 623 - protein, 23 aa, Artificial Sequence
  epitope peptide
SLLTEVETCIRNEWGCRCNDSSD

SEQ ID NO: 624 - protein, 23 aa, Artificial Sequence
  epitope peptide
SLLTEVETPIRNEWVCRCNDSSD

SEQ ID NO: 625 - protein, 23 aa, Artificial Sequence
  epitope peptide
SLLTEVETPIRNEWYCRCNDSSD

SEQ ID NO: 626 - protein, 23 aa, Artificial Sequence
  epitope peptide
SLLTEVETPIRNEWGCRCYDSSD

SEQ ID NO: 627 - protein, 23 aa, Artificial Sequence
  epitope peptide
SLLTEVETPIRIEWGCRCNDSSD

SEQ ID NO: 628 - protein, 23 aa, Artificial Sequence
  epitope peptide
SLLTEVETPIRNEWGCRCMDSSD

SEQ ID NO: 629 - protein, 23 aa, Artificial Sequence
  epitope peptide
SLLTEVMTPIRNEWGCRCNDSSD

SEQ ID NO: 630 - protein, 23 aa, Artificial Sequence
  epitope peptide
SLLTEVETPERNEWGCRCNDSSD

SEQ ID NO: 631 - protein, 23 aa, Artificial Sequence
  epitope peptide
SLLTEVETPIRKEWGCRCNDSSD

SEQ ID NO: 632 - protein, 23 aa, Artificial Sequence
  epitope peptide
SLLTEVETPIRNEWGCRCVDSSD

SEQ ID NO: 633 - protein, 23 aa, Artificial Sequence
  epitope peptide
SLLTEVETPIRNEWHCRCNDSSD

SEQ ID NO: 634 - protein, 23 aa, Artificial Sequence
  epitope peptide
SLLTEVETPIRNEWGCRANDSSD

SEQ ID NO: 635 - protein, 23 aa, Artificial Sequence
  epitope peptide
SLLTEVEAPIRNEWGCRCNDSSD

SEQ ID NO: 636 - protein, 23 aa, Artificial Sequence
  epitope peptide
SLLTEVETPIRNEIGCRCNDSSD

SEQ ID NO: 637 - protein, 23 aa, Artificial Sequence
  epitope peptide
SLLTEVETPIRNENGCRCNDSSD

SEQ ID NO: 638 - protein, 23 aa, Artificial Sequence
  epitope peptide
SLLTEVETPIRNEWGTRCNDSSD

SEQ ID NO: 639 - protein, 23 aa, Artificial Sequence
  epitope peptide
SLLTEVETPIRNEWGCFCNDSSD

SEQ ID NO: 640 - protein, 23 aa, Artificial Sequence
  epitope peptide
SLLTEVETPIRNKWGCRCNDSSD

SEQ ID NO: 641 - protein, 23 aa, Artificial Sequence
  epitope peptide
SLLTEVETPIRNELGCRCNDSSD

SEQ ID NO: 642 - protein, 23 aa, Artificial Sequence
  epitope peptide
SLLTEVETPIRNEWMCRCNDSSD

SEQ ID NO: 643 - protein, 23 aa, Artificial Sequence
  epitope peptide
SLLTEVETPIRNGWGCRCNDSSD

SEQ ID NO: 644 - protein, 23 aa, Artificial Sequence
  epitope peptide
SLLTEVETPIRNEWGVRCNDSSD

SEQ ID NO: 645 - protein, 23 aa, Artificial Sequence
  epitope peptide
SLLTEVVTPIRNEWGCRCNDSSD

SEQ ID NO: 646 - protein, 23 aa, Artificial Sequence
  epitope peptide
SLLTEVEGPIRNEWGCRCNDSSD

SEQ ID NO: 647 - protein, 23 aa, Artificial Sequence
  epitope peptide
SLLTEVETPIRNEWGHRCNDSSD

SEQ ID NO: 648 - protein, 23 aa, Artificial Sequence
  epitope peptide
SLLTEVETPIRNEWGKRCNDSSD

SEQ ID NO: 649 - protein, 23 aa, Artificial Sequence
  epitope peptide
SLLTEVETTIRNEWGCRCNDSSD

SEQ ID NO: 650 - protein, 23 aa, Artificial Sequence
  epitope peptide
SLLTEVETPVRNEWGCRCNDSSD

SEQ ID NO: 651 - protein, 23 aa, Artificial Sequence
  epitope peptide
SLLTEVETPIRNEWGCRCHDSSD

SEQ ID NO: 652 - protein, 23 aa, Artificial Sequence
  epitope peptide
SLLTEVEEPIRNEWGCRCNDSSD

SEQ ID NO: 653 - protein, 23 aa, Artificial Sequence
  epitope peptide
SLLTEVETIIRNEWGCRCNDSSD

SEQ ID NO: 654 - protein, 23 aa, Artificial Sequence
  epitope peptide
SLLTEVETPIRYEWGCRCNDSSD

SEQ ID NO: 655 - protein, 23 aa, Artificial Sequence
  epitope peptide
SLYTEVETPIRNEWGCRCNDSSD

SEQ ID NO: 656 - protein, 23 aa, Artificial Sequence
  epitope peptide
SLLTEVETPIWNEWGCRCNDSSD

SEQ ID NO: 657 - protein, 23 aa, Artificial Sequence
  epitope peptide
SLLTEVDTPIRNEWGCRCNDSSD

SEQ ID NO: 658 - protein, 23 aa, Artificial Sequence
  epitope peptide
SLLTEVYTPIRNEWGCRCNDSSD

SEQ ID NO: 659 - protein, 23 aa, Artificial Sequence
  epitope peptide
SLLTEVETPIRNEWGARCNDSSD

SEQ ID NO: 660 - protein, 23 aa, Artificial Sequence
  epitope peptide
SLLTEVETPDRNEWGCRCNDSSD

SEQ ID NO: 661 - protein, 23 aa, Artificial Sequence
  epitope peptide
SLLTEVETPIRQEWGCRCNDSSD

SEQ ID NO: 662 - protein, 23 aa, Artificial Sequence
  epitope peptide
SLLTEVETPIRNFWGCRCNDSSD

SEQ ID NO: 663 - protein, 15 aa, Artificial Sequence
  epitope peptide
MCLCTCVGMSLLTEV

SEQ ID NO: 664 - protein, 23 aa, Artificial Sequence
  epitope peptide
SLLTEVETPIRNEWGNRCNDSSD

SEQ ID NO: 665 - protein, 23 aa, Artificial Sequence
  epitope peptide
SLLTEVETPFRNEWGCRCNDSSD

SEQ ID NO: 666 - protein, 23 aa, Artificial Sequence
  epitope peptide
SLLTEVETPIRNAWGCRCNDSSD

SEQ ID NO: 667 - protein, 23 aa, Artificial Sequence
  epitope peptide
SLLTEVETPIRNEWGIRCNDSSD

SEQ ID NO: 668 - protein, 23 aa, Artificial Sequence
  epitope peptide
SLLTEVETPIRNEWGYRCNDSSD

SEQ ID NO: 669 - protein, 23 aa, Artificial Sequence
  epitope peptide
SLLTEVETPIRNEWTCRCNDSSD

SEQ ID NO: 670 - protein, 23 aa, Artificial Sequence
  epitope peptide
SLLTEVETWIRNEWGCRCNDSSD

SEQ ID NO: 671 - protein, 23 aa, Artificial Sequence
  epitope peptide
SLLTEVETPIRNEPGCRCNDSSD

SEQ ID NO: 672 - protein, 23 aa, Artificial Sequence
  epitope peptide
SLLTEVETPIRNEWGRRCNDSSD

SEQ ID NO: 673 - protein, 23 aa, Artificial Sequence
  epitope peptide
SLLTEVETPSRNEWGCRCNDSSD

SEQ ID NO: 674 - protein, 23 aa, Artificial Sequence
  epitope peptide
SLLTEVETPIRNEWGCRCTDSSD

SEQ ID NO: 675 - protein, 23 aa, Artificial Sequence
  epitope peptide
SLLTEVNTPIRNEWGCRCNDSSD

SEQ ID NO: 676 - protein, 23 aa, Artificial Sequence
  epitope peptide
SLLTEVETPIENEWGCRCNDSSD

SEQ ID NO: 677 - protein, 23 aa, Artificial Sequence
  epitope peptide
SLLTEVETPIQNEWGCRCNDSSD

SEQ ID NO: 678 - protein, 23 aa, Artificial Sequence
  epitope peptide
SLLTEVETPIRSEWGCRCNDSSD

SEQ ID NO: 679 - protein, 23 aa, Artificial Sequence
  epitope peptide
SLLTEVETPIRNEWGCECNDSSD

SEQ ID NO: 680 - protein, 23 aa, Artificial Sequence
  epitope peptide
SLLTEVETPIVNEWGCRCNDSSD

SEQ ID NO: 681 - protein, 23 aa, Artificial Sequence
  epitope peptide
SLLTEVETPIRNEWACRCNDSSD

SEQ ID NO: 682 - protein, 23 aa, Artificial Sequence
  epitope peptide
SLLTEVETPIRNEWGSRCNDSSD

SEQ ID NO: 683 - protein, 23 aa, Artificial Sequence
  epitope peptide
SLLTEVETPIRNEWGCACNDSSD

SEQ ID NO: 684 - protein, 23 aa, Artificial Sequence
  epitope peptide
SLLTEVETPIRNHWGCRCNDSSD

SEQ ID NO: 685 - protein, 23 aa, Artificial Sequence
  epitope peptide
SLLTEVETPIRNVWGCRCNDSSD

SEQ ID NO: 686 - protein, 23 aa, Artificial Sequence
  epitope peptide
SLLTEVETPIRNEWGCRLNDSSD

SEQ ID NO: 687 - protein, 23 aa, Artificial Sequence
  epitope peptide
SLLTEVETPCRNEWGCRCNDSSD

SEQ ID NO: 688 - protein, 23 aa, Artificial Sequence
  epitope peptide
SLLTEVETPIRNETGCRCNDSSD

SEQ ID NO: 689 - protein, 23 aa, Artificial Sequence
  epitope peptide
SLLTEVETPIRNEWGCRCGDSSD

SEQ ID NO: 690 - protein, 23 aa, Artificial Sequence
  epitope peptide
SLLTEVHTPIRNEWGCRCNDSSD

SEQ ID NO: 691 - protein, 23 aa, Artificial Sequence
  epitope peptide
SLLTEVETPIRNEWGCRMNDSSD

SEQ ID NO: 692 - protein, 23 aa, Artificial Sequence
  epitope peptide
SLLTEVETPILNEWGCRCNDSSD

SEQ ID NO: 693 - protein, 23 aa, Artificial Sequence
  epitope peptide
SLLTEVETPWRNEWGCRCNDSSD

SEQ ID NO: 694 - protein, 23 aa, Artificial Sequence
  epitope peptide
SLLTEVETPIRNEWGCRCNESSD

SEQ ID NO: 695 - protein, 23 aa, Artificial Sequence
  epitope peptide
SLLTEVEVPIRNEWGCRCNDSSD

SEQ ID NO: 696 - protein, 23 aa, Artificial Sequence
  epitope peptide
SLLTEVETPIRNEHGCRCNDSSD

SEQ ID NO: 697 - protein, 23 aa, Artificial Sequence
  epitope peptide
SLLTEVETPIRNEWGCRINDSSD

SEQ ID NO: 698 - protein, 23 aa, Artificial Sequence
  epitope peptide
SLLTEVETPIRDEWGCRCNDSSD

SEQ ID NO: 699 - protein, 23 aa, Artificial Sequence
  epitope peptide
SLLTEVETPIRNEWGCRYNDSSD

SEQ ID NO: 700 - protein, 23 aa, Artificial Sequence
  epitope peptide
SLLTEVETSIRNEWGCRCNDSSD

SEQ ID NO: 701 - protein, 23 aa, Artificial Sequence
  epitope peptide
SLLTEVETPIRNEWGCKCNDSSD

SEQ ID NO: 702 - protein, 23 aa, Artificial Sequence
  epitope peptide
SLLTEVETPIRNYWGCRCNDSSD

SEQ ID NO: 703 - protein, 23 aa, Artificial Sequence
  epitope peptide
SLLTEVETPIRNWWGCRCNDSSD

SEQ ID NO: 704 - protein, 23 aa, Artificial Sequence
  epitope peptide
SLLTEVETPIRNEWRCRCNDSSD

SEQ ID NO: 705 - protein, 23 aa, Artificial Sequence
  epitope peptide
SLLTEVKTPIRNEWGCRCNDSSD

SEQ ID NO: 706 - protein, 23 aa, Artificial Sequence
  epitope peptide
SLLTEVETPIRNEWGCRCADSSD

SEQ ID NO: 707 - protein, 23 aa, Artificial Sequence
  epitope peptide
SLLTEVETPIANEWGCRCNDSSD

SEQ ID NO: 708 - protein, 23 aa, Artificial Sequence
  epitope peptide
SLLTEVETPIRNEGGCRCNDSSD

SEQ ID NO: 709 - protein, 23 aa, Artificial Sequence
  epitope peptide
SLLTEVLTPIRNEWGCRCNDSSD

SEQ ID NO: 710 - protein, 23 aa, Artificial Sequence
  epitope peptide
SLLTEVETPIRREWGCRCNDSSD

SEQ ID NO: 711 - protein, 14 aa, Artificial Sequence
  epitope peptide
CSLLTEVGSLCTEV

SEQ ID NO: 712 - protein, 23 aa, Artificial Sequence
  epitope peptide
SLLTEVETPIRNDWGCRCNDSSD

SEQ ID NO: 713 - protein, 23 aa, Artificial Sequence
  epitope peptide
SLLTEVETPIRNEWGQRCNDSSD

SEQ ID NO: 714 - protein, 23 aa, Artificial Sequence
  epitope peptide
SLLTEVETPIRNEWCCRCNDSSD

SEQ ID NO: 715 - protein, 23 aa, Artificial Sequence
  epitope peptide
SLLTEVETPARNEWGCRCNDSSD

SEQ ID NO: 716 - protein, 23 aa, Artificial Sequence
  epitope peptide
SLLTEVETPIRNEFGCRCNDSSD

SEQ ID NO: 717 - protein, 23 aa, Artificial Sequence
  epitope peptide
SLLTEVETPIRNEWDCRCNDSSD

SEQ ID NO: 718 - protein, 23 aa, Artificial Sequence
  epitope peptide
SLLTEVECPIRNEWGCRCNDSSD

SEQ ID NO: 719 - protein, 23 aa, Artificial Sequence
  epitope peptide
SLLTEVETPIRNEWGCTCNDSSD

SEQ ID NO: 720 - protein, 23 aa, Artificial Sequence
  epitope peptide
SLLTEVETPIINEWGCRCNDSSD

SEQ ID NO: 721 - protein, 23 aa, Artificial Sequence
  epitope peptide
SLLTEVETPIRHEWGCRCNDSSD

SEQ ID NO: 722 - protein, 23 aa, Artificial Sequence
  epitope peptide
SLLTEVETPIRNEWGCICNDSSD

SEQ ID NO: 723 - protein, 23 aa, Artificial Sequence
  epitope peptide
SLLTEVETPIRNEWGCRFNDSSD

SEQ ID NO: 724 - protein, 15 aa, Artificial Sequence
  epitope peptide
MCLLTEVGMSLLTEC

SEQ ID NO: 725 - protein, 23 aa, Artificial Sequence
  epitope peptide
SLLTEVETPICNEWGCRCNDSSD

SEQ ID NO: 726 - protein, 23 aa, Artificial Sequence
  epitope peptide
SLLTEVETPIRNEWECRCNDSSD

SEQ ID NO: 727 - protein, 23 aa, Artificial Sequence
  epitope peptide
SLLTEVETPIRNEWGPRCNDSSD

SEQ ID NO: 728 - protein, 23 aa, Artificial Sequence
  epitope peptide
SLLTEVETPIRNEWGCRCCDSSD

SEQ ID NO: 729 - protein, 23 aa, Artificial Sequence
  epitope peptide
SLLTEVETPIRNEWGCRCSDSSD

SEQ ID NO: 730 - protein, 23 aa, Artificial Sequence
  epitope peptide
SLLTEVETPIRNEWGCMCNDSSD

SEQ ID NO: 731 - protein, 23 aa, Artificial Sequence
  epitope peptide
SLLTEVFTPIRNEWGCRCNDSSD

SEQ ID NO: 732 - protein, 23 aa, Artificial Sequence
  epitope peptide
SLLTEVETPIRNEWGMRCNDSSD

SEQ ID NO: 733 - protein, 23 aa, Artificial Sequence
  epitope peptide
SLLTEVETPIRNCWGCRCNDSSD

SEQ ID NO: 734 - protein, 23 aa, Artificial Sequence
  epitope peptide
SLLTEVETPIRNEWGCRHNDSSD

SEQ ID NO: 735 - protein, 23 aa, Artificial Sequence
  epitope peptide
SLLTEVETPIRNEWSCRCNDSSD

SEQ ID NO: 736 - protein, 23 aa, Artificial Sequence
  epitope peptide
SLLTEVETPIRNEWGCSCNDSSD

SEQ ID NO: 737 - protein, 23 aa, Artificial Sequence
  epitope peptide
SLLTEVETPIRNERGCRCNDSSD

SEQ ID NO: 738 - protein, 23 aa, Artificial Sequence
  epitope peptide
SLLTEVETPPRNEWGCRCNDSSD

SEQ ID NO: 739 - protein, 23 aa, Artificial Sequence
  epitope peptide
SLLTEVETPIRNEWGCRCEDSSD

SEQ ID NO: 740 - protein, 23 aa, Artificial Sequence
  epitope peptide
SHLTEVETPIRNEWGCRCNDSSD

SEQ ID NO: 741 - protein, 23 aa, Artificial Sequence
  epitope peptide
SLLTEVETPIRNNWGCRCNDSSD

SEQ ID NO: 742 - protein, 23 aa, Artificial Sequence
  epitope peptide
SLLTEVETPIRNEWGCVCNDSSD

SEQ ID NO: 743 - protein, 23 aa, Artificial Sequence
  epitope peptide
SLLTEVETPIRNEWGCNCNDSSD

SEQ ID NO: 744 - protein, 23 aa, Artificial Sequence
  epitope peptide
SLLTEVETPIGNEWGCRCNDSSD

SEQ ID NO: 745 - protein, 23 aa, Artificial Sequence
  epitope peptide
SLLTEVETPIRNESGCRCNDSSD

SEQ ID NO: 746 - protein, 23 aa, Artificial Sequence
  epitope peptide
SLLTEVETPIRNEWGCRNNDSSD

SEQ ID NO: 747 - protein, 14 aa, Artificial Sequence
  epitope peptide
SLCTEVGCSLLTEC

SEQ ID NO: 748 - protein, 23 aa, Artificial Sequence
  epitope peptide
SLLTEVETPIRNEWGCLCNDSSD

SEQ ID NO: 749 - protein, 15 aa, Artificial Sequence
  epitope peptide
MSLLCEVGMSLLTEV

SEQ ID NO: 750 - protein, 23 aa, Artificial Sequence
  epitope peptide
SLLTEVETPRRNEWGCRCNDSSD

SEQ ID NO: 751 - protein, 23 aa, Artificial Sequence
  epitope peptide
SLLTEVETPIRNEDGCRCNDSSD

SEQ ID NO: 752 - protein, 23 aa, Artificial Sequence
  epitope peptide
SLLTEVETPIRNEWGCRGNDSSD

SEQ ID NO: 753 - protein, 23 aa, Artificial Sequence
  epitope peptide
SLLTEVETPIRPEWGCRCNDSSD

SEQ ID NO: 754 - protein, 23 aa, Artificial Sequence
  epitope peptide
SLLTEVETPISNEWGCRCNDSSD

SEQ ID NO: 755 - protein, 23 aa, Artificial Sequence
  epitope peptide
SLLTQVETPIRNEWGCRCNDSSD

SEQ ID NO: 756 - protein, 23 aa, Artificial Sequence
  epitope peptide
SLLTEVETPIRNEWGCQCNDSSD

SEQ ID NO: 757 - protein, 23 aa, Artificial Sequence
  epitope peptide
SLLTEVETPIRNEWGCRPNDSSD

SEQ ID NO: 758 - protein, 23 aa, Artificial Sequence
  epitope peptide
SLLTEVETPTRNEWGCRCNDSSD

SEQ ID NO: 759 - protein, 23 aa, Artificial Sequence
  epitope peptide
SLHTEVETPIRNEWGCRCNDSSD

SEQ ID NO: 760 - protein, 23 aa, Artificial Sequence
  epitope peptide
SLLTEVETPIRNEWQCRCNDSSD

SEQ ID NO: 761 - protein, 15 aa, Artificial Sequence
  epitope peptide
MSLLTEVGCSCLCEV

SEQ ID NO: 762 - protein, 23 aa, Artificial Sequence
  epitope peptide
SLLTEVETPIRNEWGCRCDDSSD

SEQ ID NO: 763 - protein, 23 aa, Artificial Sequence
  epitope peptide
SLLTEVEWPIRNEWGCRCNDSSD

SEQ ID NO: 764 - protein, 23 aa, Artificial Sequence
  epitope peptide
SLLTEPETPIRNEWGCRCNDSSD

SEQ ID NO: 765 - protein, 23 aa, Artificial Sequence
  epitope peptide
SLLTEVETPIRNEQGCRCNDSSD

SEQ ID NO: 766 - protein, 23 aa, Artificial Sequence
  epitope peptide
SLLTEVETPITNEWGCRCNDSSD

SEQ ID NO: 767 - protein, 23 aa, Artificial Sequence
  epitope peptide
SLLTEVETPIRNEWGCPCNDSSD

SEQ ID NO: 768 - protein, 15 aa, Artificial Sequence
  epitope peptide
MSCLTEVGMSLLTEC

SEQ ID NO: 769 - protein, 15 aa, Artificial Sequence
  epitope peptide
MCLLTEVGCSLLTEC

SEQ ID NO: 770 - protein, 23 aa, Artificial Sequence
  epitope peptide
SLLTEVETPNRNEWGCRCNDSSD

SEQ ID NO: 771 - protein, 23 aa, Artificial Sequence
  epitope peptide
SLLTEVETPIREEWGCRCNDSSD

SEQ ID NO: 772 - protein, 23 aa, Artificial Sequence
  epitope peptide
SLLTEVETPIRNEWGCRQNDSSD

SEQ ID NO: 773 - protein, 23 aa, Artificial Sequence
  epitope peptide
SLLTEVETPIRGEWGCRCNDSSD

SEQ ID NO: 774 - protein, 23 aa, Artificial Sequence
  epitope peptide
SLLTEVETPIRNEWPCRCNDSSD

SEQ ID NO: 775 - protein, 23 aa, Artificial Sequence
  epitope peptide
SLLTEVETPIRNEWGCGCNDSSD

SEQ ID NO: 776 - protein, 23 aa, Artificial Sequence
  epitope peptide
SLLTEVETPIRNEWGCHCNDSSD

SEQ ID NO: 777 - protein, 23 aa, Artificial Sequence
  epitope peptide
SLLTEVPTPIRNEWGCRCNDSSD

SEQ ID NO: 778 - protein, 23 aa, Artificial Sequence
  epitope peptide
SLLTEVETPIKNEWGCRCNDSSD

SEQ ID NO: 779 - protein, 23 aa, Artificial Sequence
  epitope peptide
SLLTEVEDPIRNEWGCRCNDSSD

SEQ ID NO: 780 - protein, 23 aa, Artificial Sequence
  epitope peptide
SLLTEVETPINNEWGCRCNDSSD

SEQ ID NO: 781 - protein, 15 aa, Artificial Sequence
  epitope peptide
MSLLCEVGCSLLTEV

SEQ ID NO: 782 - protein, 23 aa, Artificial Sequence
  epitope peptide
SLLTEVETPQRNEWGCRCNDSSD

SEQ ID NO: 783 - protein, 23 aa, Artificial Sequence
  epitope peptide
SLLTEVEYPIRNEWGCRCNDSSD

SEQ ID NO: 784 - protein, 23 aa, Artificial Sequence
  epitope peptide
SLLTEVGTPIRNEWGCRCNDSSD

SEQ ID NO: 785 - protein, 23 aa, Artificial Sequence
  epitope peptide
SLLTEVETPIRNEWNCRCNDSSD

SEQ ID NO: 786 - protein, 23 aa, Artificial Sequence
  epitope peptide
SWLTEVETPIRNEWGCRCNDSSD

SEQ ID NO: 787 - protein, 23 aa, Artificial Sequence
  epitope peptide
SLLTEVETPIRNEEGCRCNDSSD

SEQ ID NO: 788 - protein, 23 aa, Artificial Sequence
  epitope peptide
SQLTEVETPIRNEWGCRCNDSSD

SEQ ID NO: 789 - protein, 13 aa, Artificial Sequence
  epitope peptide
SLCTEVGSLCTEV

SEQ ID NO: 790 - protein, 23 aa, Artificial Sequence
  epitope peptide
SLLTEVETPIRNEWGDRCNDSSD

SEQ ID NO: 791 - protein, 15 aa, Artificial Sequence
  epitope peptide
MSLCTEVGMCLLTEV

SEQ ID NO: 792 - protein, 14 aa, Artificial Sequence
  epitope peptide
CSLLTEVGSLLCEV

SEQ ID NO: 793 - protein, 15 aa, Artificial Sequence
  epitope peptide
MSLLTEVGMSLLCEV

SEQ ID NO: 794 - protein, 23 aa, Artificial Sequence
  epitope peptide
SLLTEVETPIRNEWGCRDNDSSD

SEQ ID NO: 795 - protein, 23 aa, Artificial Sequence
  epitope peptide
SLLTEVITPIRNEWGCRCNDSSD

SEQ ID NO: 796 - protein, 23 aa, Artificial Sequence
  epitope peptide
SLLTEVETPIRNEWGCRENDSSD

SEQ ID NO: 797 - protein, 13 aa, Artificial Sequence
  epitope peptide
SCLTEVGSLLTCV

SEQ ID NO: 798 - protein, 14 aa, Artificial Sequence
  epitope peptide
CLCTCVGCSLLTEV

SEQ ID NO: 799 - protein, 15 aa, Artificial Sequence
  epitope peptide
MSCLTEVGCSLLTEC

SEQ ID NO: 800 - protein, 15 aa, Artificial Sequence
  epitope peptide
MSLLTECGCSCLCEV

SEQ ID NO: 801 - protein, 15 aa, Artificial Sequence
  epitope peptide
MSLLTECGMSCLTEV

SEQ ID NO: 802 - protein, 23 aa, Artificial Sequence
  epitope peptide
SLGTEVETPIRNEWGCRCNDSSD

SEQ ID NO: 803 - protein, 23 aa, Artificial Sequence
  epitope peptide
SLLSEVETPIRNEWGCRCNDSSD

SEQ ID NO: 804 - protein, 23 aa, Artificial Sequence
  epitope peptide
SLWTEVETPIRNEWGCRCNDSSD

SEQ ID NO: 805 - protein, 15 aa, Artificial Sequence
  epitope peptide
MSLLTCVGMSLLTEC

SEQ ID NO: 806 - protein, 13 aa, Artificial Sequence
  epitope peptide
SLCTEVGCLLTEV

SEQ ID NO: 807 - protein, 14 aa, Artificial Sequence
  epitope peptide
CLLTEVGCSLLTEV

SEQ ID NO: 808 - protein, 14 aa, Artificial Sequence
  epitope peptide
SCLTEVGCSLLTEC

SEQ ID NO: 809 - protein, 14 aa, Artificial Sequence
  epitope peptide
CSLLTECGCLLTEV

SEQ ID NO: 810 - protein, 14 aa, Artificial Sequence
  epitope peptide
SLLTCVGCSLLTEV

SEQ ID NO: 811 - protein, 14 aa, Artificial Sequence
  epitope peptide
CSLLTECGCLCTCV

SEQ ID NO: 812 - protein, 14 aa, Artificial Sequence
  epitope peptide
SLLTCVGCSLLTEC

SEQ ID NO: 813 - protein, 14 aa, Artificial Sequence
  epitope peptide
CSLLTECGSLLTEC

SEQ ID NO: 814 - protein, 14 aa, Artificial Sequence
  epitope peptide
CSLLTECGSLLCEV

SEQ ID NO: 815 - protein, 14 aa, Artificial Sequence
  epitope peptide
CSLLTECGSCLCEC

SEQ ID NO: 816 - protein, 14 aa, Artificial Sequence
  epitope peptide
CLLTEVGCSLLTEC

SEQ ID NO: 817 - protein, 15 aa, Artificial Sequence
  epitope peptide
CSLLTECGCSCLCEV

SEQ ID NO: 818 - protein, 15 aa, Artificial Sequence
  epitope peptide
MSLLTECGCSLLTEC

SEQ ID NO: 819 - protein, 14 aa, Artificial Sequence
  epitope peptide
CLCTCVGCSLLTEC

SEQ ID NO: 820 - protein, 15 aa, Artificial Sequence
  epitope peptide
MSLLTCVGCSLLTEC

SEQ ID NO: 821 - protein, 15 aa, Artificial Sequence
  epitope peptide
CSCLCEVGCSLLTEV

SEQ ID NO: 822 - protein, 23 aa, Artificial Sequence
  epitope peptide
SLLTDVETPIRNEWGCRCNDSSD

SEQ ID NO: 823 - protein, 13 aa, Artificial Sequence
  epitope peptide
SCLTEVGSLLTEC

SEQ ID NO: 824 - protein, 13 aa, Artificial Sequence
  epitope peptide
SLLTCVGSLLTEV

SEQ ID NO: 825 - protein, 15 aa, Artificial Sequence
  epitope peptide
MSLLCEVGMSLLTEC

SEQ ID NO: 826 - protein, 15 aa, Artificial Sequence
  epitope peptide
MSLLCEVGCSLLTEC

SEQ ID NO: 827 - protein, 15 aa, Artificial Sequence
  epitope peptide
MSCLCECGCSLLTEV

SEQ ID NO: 828 - protein, 15 aa, Artificial Sequence
  epitope peptide
MCLCTCVGMSLLTEC

SEQ ID NO: 829 - protein, 15 aa, Artificial Sequence
  epitope peptide
MSLLTEVGMSCLCEC

SEQ ID NO: 830 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): I is an attachment site for a CLIP
CSLLTEVETPSLLTEVETPCLLTEVETPI

SEQ ID NO: 831 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): P is an attachment site for a CLIP
CSLLTEVETPSLLTEVETPCSLLTEVETP

SEQ ID NO: 832 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): I is an attachment site for a CLIP
CLTEVETPIRSLLTEVETPCLLTEVETPI

SEQ ID NO: 833 - protein, 29 aa, Artificial Sequence
  epitope peptide
SLLTEVETCSLLTEVETATPIRNEWGCRC

SEQ ID NO: 834 - protein, 30 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (29)..(29): G is an attachment site for a CLIP
  MISC_FEATURE (30)..(30): R is an attachment site for a CLIP
SLLTEVETCSLLTEVETSLLTEVETCEWGR

SEQ ID NO: 835 - protein, 30 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (29)..(29): R is an attachment site for a CLIP
SLLTEVETCSLLTEVETSLLTEVETAWGCR

SEQ ID NO: 836 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): P is an attachment site for a CLIP
CLTEVETPIRSLLTEVETPCSLLTEVETP

SEQ ID NO: 837 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): I is an attachment site for a CLIP
CETPIRNEWGSLLTEVETPCLLTEVETPI

SEQ ID NO: 838 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): I is an attachment site for a CLIP
CTEVETPIRNSLLTEVETPCLLTEVETPI

SEQ ID NO: 839 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): P is an attachment site for a CLIP
CTEVETPIRNSLLTEVETPCSLLTEVETP

SEQ ID NO: 840 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): R is an attachment site for a CLIP
SLLTEVETCSLLTEVETSLLTEVETCEWGSR

SEQ ID NO: 841 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): P is an attachment site for a CLIP
CSLLTEVETPLTEVETPIRCSLLTEVETP

SEQ ID NO: 842 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): P is an attachment site for a CLIP
CSLLTEVETPTEVETPIRNCSLLTEVETP

SEQ ID NO: 843 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): R is an attachment site for a CLIP
CVETPIRNEWSLLTEVETPCLTEVETPIR

SEQ ID NO: 844 - protein, 30 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (29)..(29): R is an attachment site for a CLIP
SLLTEVETCSLLTEVETSLLTEVETAGCRN

SEQ ID NO: 845 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): S is an attachment site for a CLIP
CSLLTEVETPSLLTEVETPCETPIRNEWG

SEQ ID NO: 846 - protein, 30 aa, Artificial Sequence
  epitope peptide
SLLTEVETCSLLTEVETCNEWGSRSNDSSC

SEQ ID NO: 847 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): I is an attachment site for a CLIP
CLLTEVETPISLLTEVETPCLLTEVETPI

SEQ ID NO: 848 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): P is an attachment site for a CLIP
CEVETPIRNESLLTEVETPCSLLTEVETP

SEQ ID NO: 849 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): P is an attachment site for a CLIP
CLLTEVETPILTEVETPIRCSLLTEVETP

SEQ ID NO: 850 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): W is an attachment site for a CLIP
CSLLTEVETPSLLTEVETPCVETPIRNEW

SEQ ID NO: 851 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): P is an attachment site for a CLIP
CSLLTEVETPVETPIRNEWCSLLTEVETP

SEQ ID NO: 852 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): W is an attachment site for a CLIP
SLLTEVETCSLLTEVETSLLTEVETCIRNEW

SEQ ID NO: 853 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): V is an attachment site for a CLIP
SLLTEVETCSLLTEVETSLLTEVETCLLTEV

SEQ ID NO: 854 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): P is an attachment site for a CLIP
CTEVETPIRNLTEVETPIRCSLLTEVETP

SEQ ID NO: 855 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): I is an attachment site for a CLIP
CEVETPIRNESLLTEVETPCLLTEVETPI

SEQ ID NO: 856 - protein, 29 aa, Artificial Sequence
  epitope peptide
SLLTEVETCSLLTEVETCVETPIRNEWGC

SEQ ID NO: 857 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): R is an attachment site for a CLIP
CLTEVETPIRSLLTEVETPCLTEVETPIR

SEQ ID NO: 858 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): P is an attachment site for a CLIP
CETPIRNEWGSLLTEVETPCSLLTEVETP

SEQ ID NO: 859 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): R is an attachment site for a CLIP
CSLLTEVETPSLLTEVETPCLTEVETPIR

SEQ ID NO: 860 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): P is an attachment site for a CLIP
CVETPIRNEWSLLTEVETPCSLLTEVETP

SEQ ID NO: 861 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): E is an attachment site for a CLIP
SLLTEVETCSLLTEVETSLLTEVETCSLLTE

SEQ ID NO: 862 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): N is an attachment site for a CLIP
SLLTEVETCSLLTEVETSLLTEVETCTPIRN

SEQ ID NO: 863 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): P is an attachment site for a CLIP
CLTEVETPIRLTEVETPIRCSLLTEVETP

SEQ ID NO: 864 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): R is an attachment site for a CLIP
CTEVETPIRNSLLTEVETPCLTEVETPIR

SEQ ID NO: 865 - protein, 29 aa, Artificial Sequence
  epitope peptide
SLLTEVETCSLLTEVETAEWGCRCNDSSD

SEQ ID NO: 866 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): G is an attachment site for a CLIP
CVETPIRNEWSLLTEVETPCETPIRNEWG

SEQ ID NO: 867 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): P is an attachment site for a CLIP
CLLTEVETPISLLTEVETPCSLLTEVETP

SEQ ID NO: 868 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): G is an attachment site for a CLIP
CEVETPIRNESLLTEVETPCETPIRNEWG

SEQ ID NO: 869 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): P is an attachment site for a CLIP
CSLLTEVETPEVETPIRNECSLLTEVETP

SEQ ID NO: 870 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): E is an attachment site for a CLIP
  MISC_FEATURE (29)..(29): P is an attachment site for a CLIP
CEVETPIRNEEVETPIRNECSLLTEVETP

SEQ ID NO: 871 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): I is an attachment site for a CLIP
CVETPIRNEWSLLTEVETPCLLTEVETPI

SEQ ID NO: 872 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): P is an attachment site for a CLIP
CEVETPIRNELTEVETPIRCSLLTEVETP

SEQ ID NO: 873 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): I is an attachment site for a CLIP
CSLLTEVETPVETPIRNEWCLLTEVETPI

SEQ ID NO: 874 - protein, 30 aa, Artificial Sequence
  epitope peptide
SLLTEVETCSLLTEVETCEWGSRSNDSSDC

SEQ ID NO: 875 - protein, 30 aa, Artificial Sequence
  epitope peptide
SLLTEVETCSLLTEVETCSLLTEVETPIRC

SEQ ID NO: 876 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): P is an attachment site for a CLIP
CVETPIRNEWLTEVETPIRCSLLTEVETP

SEQ ID NO: 877 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): E is an attachment site for a CLIP
  MISC_FEATURE (29)..(29): P is an attachment site for a CLIP
CVETPIRNEWETPIRNEWGCSLLTEVETP

SEQ ID NO: 878 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): I is an attachment site for a CLIP
CSLLTEVETPTEVETPIRNCLLTEVETPI

SEQ ID NO: 879 - protein, 29 aa, Artificial Sequence
  epitope peptide
SLLTEVETCSLLTEVETCETPIRNEWGCR

SEQ ID NO: 880 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): T is an attachment site for a CLIP
  MISC_FEATURE (29)..(29): P is an attachment site for a CLIP
CLTEVETPIRTEVETPIRNCSLLTEVETP

SEQ ID NO: 881 - protein, 33 aa, Artificial Sequence
  epitope peptide
CSLLTEVETPIRNEWGCETPIRNEWGSRSNDSC

SEQ ID NO: 882 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): P is an attachment site for a CLIP
CETPIRNEWGLTEVETPIRCSLLTEVETP

SEQ ID NO: 883 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): P is an attachment site for a CLIP
CLLTEVETPITEVETPIRNCSLLTEVETP

SEQ ID NO: 884 - protein, 30 aa, Artificial Sequence
  epitope peptide
SLLTEVETCSLLTEVETCRNEWGSRSNDSC

SEQ ID NO: 885 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): P is an attachment site for a CLIP
CSLLTEVETPETPIRNEWGCSLLTEVETP

SEQ ID NO: 886 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): R is an attachment site for a CLIP
CSLLTEVETPLTEVETPIRCLTEVETPIR

SEQ ID NO: 887 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): T is an attachment site for a CLIP
  MISC_FEATURE (29)..(29): P is an attachment site for a CLIP
CTEVETPIRNTEVETPIRNCSLLTEVETP

SEQ ID NO: 888 - protein, 26 aa, Artificial Sequence
  epitope peptide
CSLLTEVETCPIRNEWGSRSNDSSDC

SEQ ID NO: 889 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): O is an attachment site for a CLIP
CSLLTEVETPEVETPIRNECLLTEVETPI

SEQ ID NO: 890 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): R is an attachment site for a CLIP
SLLTEVETCSLLTEVETSLLTEVETCETPIR

SEQ ID NO: 891 - protein, 30 aa, Artificial Sequence
  epitope peptide
CSLLTEVETPIRNCETPIRNEWGSRSNDSC

SEQ ID NO: 892 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): R is an attachment site for a CLIP
CSLLTEVETPLLTEVETPICLTEVETPIR

SEQ ID NO: 893 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (29)..(29): I is an attachment site for a CLIP
SLLTEVETCSLLTEVETSLLTEVETCVETPI

SEQ ID NO: 894 - protein, 26 aa, Artificial Sequence
  epitope peptide
CSLLTEVETCTPIRNEWGSRSNDSSC

SEQ ID NO: 895 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (29)..(29): G is an attachment site for a CLIP
SLLTEVETCSLLTEVETSLLTEVETCRNEWG

SEQ ID NO: 896 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): E is an attachment site for a CLIP
  MISC_FEATURE (29)..(29): P is an attachment site for a CLIP
CETPIRNEWGETPIRNEWGCSLLTEVETP

SEQ ID NO: 897 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): R is an attachment site for a CLIP
CEVETPIRNESLLTEVETPCLTEVETPIR

SEQ ID NO: 898 - protein, 30 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (28)..(28): R is an attachment site for a CLIP
SLLTEVETCSLLTEVETSLLTEVETACRND

SEQ ID NO: 899 - protein, 29 aa, Artificial Sequence
  epitope peptide
SLLTEVETCSLLTEVETAPIRNEWGCRCN

SEQ ID NO: 900 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): P is an attachment site for a CLIP
CSLLTEVETPLLTEVETPICSLLTEVETP

SEQ ID NO: 901 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): E is an attachment site for a CLIP
SLLTEVETCSLLTEVETSLLTEVETCLTEVE

SEQ ID NO: 902 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): E is an attachment site for a CLIP
  MISC_FEATURE (29)..(29): P is an attachment site for a CLIP
CLTEVETPIRETPIRNEWGCSLLTEVETP

SEQ ID NO: 903 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): E is an attachment site for a CLIP
  MISC_FEATURE (29)..(29): P is an attachment site for a CLIP
CEVETPIRNEETPIRNEWGCSLLTEVETP

SEQ ID NO: 904 - protein, 29 aa, Artificial Sequence
  epitope peptide
SLLTEVETCSLLTEVETAIRNEWGCRCND

SEQ ID NO: 905 - protein, 28 aa, Artificial Sequence
  epitope peptide
CSLLTEVETPICETPIRNEWGSRSNDSC

SEQ ID NO: 906 - protein, 33 aa, Artificial Sequence
  epitope peptide
CSLLTEVETPIRNEWGCPIRNEWGSRSNDSSDC

SEQ ID NO: 907 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): E is an attachment site for a CLIP
SLLTEVETCSLLTEVETSLLTEVETCPIRNE

SEQ ID NO: 908 - protein, 30 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (30)..(30): G is an attachment site for a CLIP
SLLTEVETCSLLTEVETSLLTEVETCNEWG

SEQ ID NO: 909 - protein, 30 aa, Artificial Sequence
  epitope peptide
SLLTEVETCSLLTEVETCLLTEVETPIRNC

SEQ ID NO: 910 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): R is an attachment site for a CLIP
CETPIRNEWGSLLTEVETPCLTEVETPIR

SEQ ID NO: 911 - protein, 29 aa, Artificial Sequence
  epitope peptide
CSLLTEVETPIRCETPIRNEWGSRSNDSC

SEQ ID NO: 912 - protein, 30 aa, Artificial Sequence
  epitope peptide
SLLTEVETCSLLTEVETCTPIRNEWGSRSC

SEQ ID NO: 913 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): E is an attachment site for a CLIP
CTEVETPIRNSLLTEVETPCEVETPIRNE

SEQ ID NO: 914 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): P is an attachment site for a CLIP
SLLTEVETCSLLTEVETSLLTEVETCEVETP

SEQ ID NO: 915 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): T is an attachment site for a CLIP
SLLTEVETCSLLTEVETSLLTEVETCTEVET

SEQ ID NO: 916 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): I is an attachment site for a CLIP
CSLLTEVETPLTEVETPIRCLLTEVETPI

SEQ ID NO: 917 - protein, 31 aa, Artificial Sequence
  epitope peptide
CSLLTEVETPIRNECETPIRNEWGSRSNDSC

SEQ ID NO: 918 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): N is an attachment site for a CLIP
CSLLTEVETPSLLTEVETPCTEVETPIRN

SEQ ID NO: 919 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): T is an attachment site for a CLIP
  MISC_FEATURE (29)..(29): P is an attachment site for a CLIP
CETPIRNEWGTEVETPIRNCSLLTEVETP

SEQ ID NO: 920 - protein, 31 aa, Artificial Sequence
  epitope peptide
CSLLTEVETPIRNECTPIRNEWGSRSNDSSC

SEQ ID NO: 921 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): T is an attachment site for a CLIP
  MISC_FEATURE (29)..(29): P is an attachment site for a CLIP
CEVETPIRNETEVETPIRNCSLLTEVETP

SEQ ID NO: 922 - protein, 27 aa, Artificial Sequence
  epitope peptide
CSLLTEVETPCETPIRNEWGSRSNDSC

SEQ ID NO: 923 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): I is an attachment site for a CLIP
CSLLTEVETPLLTEVETPICLLTEVETPI

SEQ ID NO: 924 - protein, 29 aa, Artificial Sequence
  epitope peptide
CSLLTEVETPIRCTPIRNEWGSRSNDSSC

SEQ ID NO: 925 - protein, 30 aa, Artificial Sequence
  epitope peptide
SLLTEVETCSLLTEVETCVETPIRNEWGSC

SEQ ID NO: 926 - protein, 29 aa, Artificial Sequence
  epitope peptide
SLLTEVETCSLLTEVETARNEWGCRCNDS

SEQ ID NO: 927 - protein, 30 aa, Artificial Sequence
  epitope peptide
SLLTEVETCSLLTEVETCETPIRNEWGSRC

SEQ ID NO: 928 - protein, 29 aa, Artificial Sequence
  epitope peptide
SLLTEVETCSLLTEVETANEWGCRCNDSS

SEQ ID NO: 929 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): V is an attachment site for a CLIP
  MISC_FEATURE (29)..(29): P is an attachment site for a CLIP
CETPIRNEWGVETPIRNEWCSLLTEVETP

SEQ ID NO: 930 - protein, 30 aa, Artificial Sequence
  epitope peptide
SLLTEVETCSLLTEVETCEVETPIRNEWGC

SEQ ID NO: 931 - protein, 27 aa, Artificial Sequence
  epitope peptide
CSLLTEVETPCPIRNEWGSRSNDSSDC

SEQ ID NO: 932 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): V is an attachment site for a CLIP
  MISC_FEATURE (29)..(29): P is an attachment site for a CLIP
CLTEVETPIRVETPIRNEWCSLLTEVETP

SEQ ID NO: 933 - protein, 30 aa, Artificial Sequence
  epitope peptide
SLLTEVETCSLLTEVETCPIRNEWGSRSNC

SEQ ID NO: 934 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): V is an attachment site for a CLIP
  MISC_FEATURE (29)..(29): P is an attachment site for a CLIP
CEVETPIRNEVETPIRNEWCSLLTEVETP

SEQ ID NO: 935 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): W is an attachment site for a CLIP
CVETPIRNEWSLLTEVETPCVETPIRNEW

SEQ ID NO: 936 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): E is an attachment site for a CLIP
  MISC_FEATURE (29)..(29): P is an attachment site for a CLIP
CETPIRNEWGEVETPIRNECSLLTEVETP

SEQ ID NO: 937 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): I is an attachment site for a CLIP
CSLLTEVETPETPIRNEWGCLLTEVETPI

SEQ ID NO: 938 - protein, 26 aa, Artificial Sequence
  epitope peptide
CSLLTEVETCETPIRNEWGSRSNDSC

SEQ ID NO: 939 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): G is an attachment site for a CLIP
CSLLTEVETPLLTEVETPICETPIRNEWG

SEQ ID NO: 940 - protein, 30 aa, Artificial Sequence
  epitope peptide
SLLTEVETCSLLTEVETCTEVETPIRNEWC

SEQ ID NO: 941 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): N is an attachment site for a CLIP
CEVETPIRNESLLTEVETPCTEVETPIRN

SEQ ID NO: 942 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): N is an attachment site for a CLIP
CETPIRNEWGSLLTEVETPCTEVETPIRN

SEQ ID NO: 943 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): P is an attachment site for a CLIP
CLLTEVETPIVETPIRNEWCSLLTEVETP

SEQ ID NO: 944 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): R is an attachment site for a CLIP
CSLLTEVETPTEVETPIRNCLTEVETPIR

SEQ ID NO: 945 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): W is an attachment site for a CLIP
CLTEVETPIRSLLTEVETPCVETPIRNEW

SEQ ID NO: 946 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): N is an attachment site for a CLIP
CLTEVETPIRSLLTEVETPCTEVETPIRN

SEQ ID NO: 947 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): N is an attachment site for a CLIP
CVETPIRNEWSLLTEVETPCTEVETPIRN

SEQ ID NO: 948 - protein, 30 aa, Artificial Sequence
  epitope peptide
SLLTEVETCSLLTEVETCIRNEWGSRSNDC

SEQ ID NO: 949 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): R is an attachment site for a CLIP
CLLTEVETPISLLTEVETPCLTEVETPIR

SEQ ID NO: 950 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): W is an attachment site for a CLIP
CETPIRNEWGSLLTEVETPCVETPIRNEW

SEQ ID NO: 951 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): W is an attachment site for a CLIP
CTEVETPIRNSLLTEVETPCVETPIRNEW

SEQ ID NO: 952 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): V is an attachment site for a CLIP
  MISC_FEATURE (29)..(29): P is an attachment site for a CLIP
CTEVETPIRNVETPIRNEWCSLLTEVETP

SEQ ID NO: 953 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): T is an attachment site for a CLIP
  MISC_FEATURE (29)..(29): P is an attachment site for a CLIP
CVETPIRNEWTEVETPIRNCSLLTEVETP

SEQ ID NO: 954 - protein, 28 aa, Artificial Sequence
  epitope peptide
CSLLTEVETPICPIRNEWGSRSNDSSDC

SEQ ID NO: 955 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): V is an attachment site for a CLIP
  MISC_FEATURE (29)..(29): P is an attachment site for a CLIP
CVETPIRNEWVETPIRNEWCSLLTEVETP

SEQ ID NO: 956 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): G is an attachment site for a CLIP
CTEVETPIRNSLLTEVETPCETPIRNEWG

SEQ ID NO: 957 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): N is an attachment site for a CLIP
CTEVETPIRNSLLTEVETPCTEVETPIRN

SEQ ID NO: 958 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): W is an attachment site for a CLIP
CSLLTEVETPSLLTEVETPCEVETPIRNE

SEQ ID NO: 959 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): W is an attachment site for a CLIP
CEVETPIRNESLLTEVETPCVETPIRNEW

SEQ ID NO: 960 - protein, 30 aa, Artificial Sequence
  epitope peptide
SLLTEVETCSLLTEVETCLTEVETPIRNEC

SEQ ID NO: 961 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): E is an attachment site for a CLIP
  MISC_FEATURE (29)..(29): P is an attachment site for a CLIP
CLTEVETPIREVETPIRNECSLLTEVETP

SEQ ID NO: 962 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): G is an attachment site for a CLIP
CLTEVETPIRSLLTEVETPCETPIRNEWG

SEQ ID NO: 963 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): E is an attachment site for a CLIP
  MISC_FEATURE (29)..(29): P is an attachment site for a CLIP
CVETPIRNEWEVETPIRNECSLLTEVETP

SEQ ID NO: 964 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): G is an attachment site for a CLIP
CETPIRNEWGSLLTEVETPCETPIRNEWG

SEQ ID NO: 965 - protein, 27 aa, Artificial Sequence
  epitope peptide
CSLLTEVETPCTPIRNEWGSRSNDSSC

SEQ ID NO: 966 - protein, 28 aa, Artificial Sequence
  epitope peptide
CSLLTEVETPICTPIRNEWGSRSNDSSC

SEQ ID NO: 967 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): P is an attachment site for a CLIP
CLLTEVETPIEVETPIRNECSLLTEVETP

SEQ ID NO: 968 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): P is an attachment site for a CLIP
CLLTEVETPIETPIRNEWGCSLLTEVETP

SEQ ID NO: 969 - protein, 29 aa, Artificial Sequence
  epitope peptide
CSLLTEVETPIRCPIRNEWGSRSNDSSDC

SEQ ID NO: 970 - protein, 30 aa, Artificial Sequence
  epitope peptide
CSLLTEVETPIRNCPIRNEWGSRSNDSSDC

SEQ ID NO: 971 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): N is an attachment site for a CLIP
CSLLTEVETPLTEVETPIRCTEVETPIRN

SEQ ID NO: 972 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): G is an attachment site for a CLIP
CSLLTEVETPLTEVETPIRCETPIRNEWG

SEQ ID NO: 973 - protein, 31 aa, Artificial Sequence
  epitope peptide
CSLLTEVETPIRNECPIRNEWGSRSNDSSDC

SEQ ID NO: 974 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): W is an attachment site for a CLIP
CSLLTEVETPLLTEVETPICVETPIRNEW

SEQ ID NO: 975 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): W is an attachment site for a CLIP
CLLTEVETPISLLTEVETPCVETPIRNEW

SEQ ID NO: 976 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): S is an attachment site for a CLIP
  MISC_FEATURE (29)..(29): E is an attachment site for a CLIP
CLTEVETPIRSLLTEVETPCEVETPIRNE

SEQ ID NO: 977 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): P is an attachment site for a CLIP
CVETPIRNEWLLTEVETPICSLLTEVETP

SEQ ID NO: 978 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): E is an attachment site for a CLIP
  MISC_FEATURE (29)..(29): P is an attachment site for a CLIP
CTEVETPIRNEVETPIRNECSLLTEVETP

SEQ ID NO: 979 - protein, 30 aa, Artificial Sequence
  epitope peptide
CSLLTEVETPIRNCTPIRNEWGSRSNDSSC

SEQ ID NO: 980 - protein, 33 aa, Artificial Sequence
  epitope peptide
CSLLTEVETPIRNEWGCTPIRNEWGSRSNDSSC

SEQ ID NO: 981 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): N is an attachment site for a CLIP
CSLLTEVETPTEVETPIRNCTEVETPIRN

SEQ ID NO: 982 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): E is an attachment site for a CLIP
  MISC_FEATURE (29)..(29): P is an attachment site for a CLIP
CTEVETPIRNETPIRNEWGCSLLTEVETP

SEQ ID NO: 983 - protein, 31 aa, Artificial Sequence
  epitope peptide
  MISC_FEATURE (8)..(8): T is an attachment site for a CLIP
  MISC_FEATURE (9)..(9): C is an attachment site for a CLIP
  MISC_FEATURE (17)..(17): T is an attachment site for a CLIP
  MISC_FEATURE (18)..(18): S is an attachment site for a CLIP
  MISC_FEATURE (31)..(31): S is an attachment site for a CLIP
SLLTEVETCSLLTEVETSLLTEVETCNEWGS

SEQ ID NO: 984 - protein, 14 aa, Artificial Sequence
  epitope peptide
CSLLTEVETPIRNC

SEQ ID NO: 985 - protein, 15 aa, Artificial Sequence
  epitope peptide
SLLTEVCTCIRNEWG

SEQ ID NO: 986 - protein, 27 aa, Artificial Sequence
  epitope peptide
SLLTEVETCSLLTEVETPIRNEWGSRC

SEQ ID NO: 987 - protein, 15 aa, Artificial Sequence
  epitope peptide
SLLTEVCTPICNEWG

SEQ ID NO: 988 - protein, 15 aa, Artificial Sequence
  epitope peptide
SLLTEVCTPIRCEWG

SEQ ID NO: 989 - protein, 15 aa, Artificial Sequence
  epitope peptide
SLLTEVECPIRCEWG

SEQ ID NO: 990 - protein, 14 aa, Artificial Sequence
  epitope peptide
CSLLTEVCTPIRNE

SEQ ID NO: 991 - protein, 16 aa, Artificial Sequence
  epitope peptide
SLLTEVETCIRNEWGC

SEQ ID NO: 992 - protein, 15 aa, Artificial Sequence
  epitope peptide
SLLTEVETCIRNCWG

SEQ ID NO: 993 - protein, 15 aa, Artificial Sequence
  epitope peptide
SLLTEVETCCRNEWG

SEQ ID NO: 994 - protein, 15 aa, Artificial Sequence
  epitope peptide
SLLTEVETPIRCCWG

SEQ ID NO: 995 - protein, 28 aa, Artificial Sequence
  epitope peptide
SLLTEVETSLLTEVETPIRNEWGCRCND

SEQ ID NO: 996 - protein, 15 aa, Artificial Sequence
  epitope peptide
SLLTEVCTPCRNEWG

SEQ ID NO: 997 - protein, 14 aa, Artificial Sequence
  epitope peptide
CSLLTEVETPIRCE

SEQ ID NO: 998 - protein, 15 aa, Artificial Sequence
  epitope peptide
SLLTEVETCIRCEWG

SEQ ID NO: 999 - protein, 28 aa, Artificial Sequence
  epitope peptide
SLLTEVETCSLLTEVETPIRNEWGSRSC

SEQ ID NO: 1000 - protein, 15 aa, Artificial Sequence
  epitope peptide
SLLTEVCTPIRNCWG

SEQ ID NO: 1001 - protein, 15 aa, Artificial Sequence
  epitope peptide
SLLTEVECPIRNCWG

SEQ ID NO: 1002 - protein, 15 aa, Artificial Sequence
  epitope peptide
SLCTEVETCIRNEWG

SEQ ID NO: 1003 - protein, 15 aa, Artificial Sequence
  epitope peptide
SLLTECETCIRNEWG

SEQ ID NO: 1004 - protein, 15 aa, Artificial Sequence
  epitope peptide
SLLTEVECCIRNEWG

SEQ ID NO: 1005 - protein, 15 aa, Artificial Sequence
  epitope peptide
SLLTEVETPCRNCWG

SEQ ID NO: 1006 - protein, 15 aa, Artificial Sequence
  epitope peptide
SLLTEVETCICNEWG

SEQ ID NO: 1007 - protein, 13 aa, Artificial Sequence
  epitope peptide
SLLTEVECPIRNC

SEQ ID NO: 1008 - protein, 15 aa, Artificial Sequence
  epitope peptide
SLLTECETPIRNCWG

SEQ ID NO: 1009 - protein, 15 aa, Artificial Sequence
  epitope peptide
SLLTEVETCIRNEWG

SEQ ID NO: 1010 - protein, 15 aa, Artificial Sequence
  epitope peptide
SLLTEVETPICNCWG

SEQ ID NO: 1011 - protein, 29 aa, Artificial Sequence
  epitope peptide
SLLTEVETCSLLTEVETPIRNEWGSRSNC

SEQ ID NO: 1012 - protein, 14 aa, Artificial Sequence
  epitope peptide
CSLLTEVETPICNE

SEQ ID NO: 1013 - protein, 14 aa, Artificial Sequence
  epitope peptide
CSLLTEVETCIRNE

SEQ ID NO: 1014 - protein, 15 aa, Artificial Sequence
  epitope peptide
SLLTEVCCPIRNEWG

SEQ ID NO: 1015 - protein, 16 aa, Artificial Sequence
  epitope peptide
SLLTEVETPIRNCWGC

SEQ ID NO: 1016 - protein, 13 aa, Artificial Sequence
  epitope peptide
SLLTEVCTPIRNC

SEQ ID NO: 1017 - protein, 15 aa, Artificial Sequence
  epitope peptide
SLLTEVECPIRNEWC

SEQ ID NO: 1018 - protein, 14 aa, Artificial Sequence
  epitope peptide
CSLLTEVETPIRNE

SEQ ID NO: 1019 - protein, 15 aa, Artificial Sequence
  epitope peptide
SLLTEVCTPIRNEWG

SEQ ID NO: 1020 - protein, 14 aa, Artificial Sequence
  epitope peptide
CSLLTEVETPCRNE

SEQ ID NO: 1021 - protein, 16 aa, Artificial Sequence
  epitope peptide
SLLTEVETPIRCEWGC

SEQ ID NO: 1022 - protein, 13 aa, Artificial Sequence
  epitope peptide
SLLTEVETCIRNC

SEQ ID NO: 1023 - protein, 15 aa, Artificial Sequence
  epitope peptide
SLLTEVETPIRCECG

SEQ ID NO: 1024 - protein, 14 aa, Artificial Sequence
  epitope peptide
CSLLTEVECPIRNE

SEQ ID NO: 1025 - protein, 15 aa, Artificial Sequence
  epitope peptide
SLLTEVECPCRNEWG

SEQ ID NO: 1026 - protein, 15 aa, Artificial Sequence
  epitope peptide
SCLTEVETPCRNEWG

SEQ ID NO: 1027 - protein, 14 aa, Artificial Sequence
  epitope peptide
CSLLTECETPIRNE

SEQ ID NO: 1028 - protein, 15 aa, Artificial Sequence
  epitope peptide
SLLTEVECPICNEWG

SEQ ID NO: 1029 - protein, 15 aa, Artificial Sequence
  epitope peptide
SLLTECETPIRCEWG

SEQ ID NO: 1030 - protein, 15 aa, Artificial Sequence
  epitope peptide
SLLTEVETCIRNEWC

SEQ ID NO: 1031 - protein, 13 aa, Artificial Sequence
  epitope peptide
SLCTEVETPIRNC

SEQ ID NO: 1032 - protein, 26 aa, Artificial Sequence
  epitope peptide
SLLTEVETCSLLTEVETPIRNEWGCR

SEQ ID NO: 1033 - protein, 15 aa, Artificial Sequence
  epitope peptide
SLLTECECPIRNEWG

SEQ ID NO: 1034 - protein, 15 aa, Artificial Sequence
  epitope peptide
SLLTEVETPICCEWG

SEQ ID NO: 1035 - protein, 13 aa, Artificial Sequence
  epitope peptide
SLLTEVECPIRCE

SEQ ID NO: 1036 - protein, 15 aa, Artificial Sequence
  epitope peptide
SLLTEVETPIRNCWG

SEQ ID NO: 1037 - protein, 13 aa, Artificial Sequence
  epitope peptide
SCLTEVCTPIRNE

SEQ ID NO: 1038 - protein, 15 aa, Artificial Sequence
  epitope peptide
SCLTEVETCIRNEWG

SEQ ID NO: 1039 - protein, 15 aa, Artificial Sequence
  epitope peptide
SLLTEVETPIRNCWC

SEQ ID NO: 1040 - protein, 21 aa, Artificial Sequence
  epitope peptide
SLLTEVETCSLLTEVETPIRC

SEQ ID NO: 1041 - protein, 15 aa, Artificial Sequence
  epitope peptide
SLLTEVECPIRNEWG

SEQ ID NO: 1042 - protein, 26 aa, Artificial Sequence
  epitope peptide
SLLTEVETSLLTEVETPIRNEWGCRC

SEQ ID NO: 1043 - protein, 27 aa, Artificial Sequence
  epitope peptide
SLLTEVETSLLTEVETPIRNEWGCRCN

SEQ ID NO: 1044 - protein, 13 aa, Artificial Sequence
  epitope peptide
SLLTEVCTCIRNE

SEQ ID NO: 1045 - protein, 13 aa, Artificial Sequence
  epitope peptide
SLCTEVETPIRCE

SEQ ID NO: 1046 - protein, 15 aa, Artificial Sequence
  epitope peptide
SLLTEVETCIRNECG

SEQ ID NO: 1047 - protein, 13 aa, Artificial Sequence
  epitope peptide
SCLTEVETPIRNC

SEQ ID NO: 1048 - protein, 25 aa, Artificial Sequence
  epitope peptide
SLLTEVETCSLLTEVETPIRNEWGC

SEQ ID NO: 1049 - protein, 15 aa, Artificial Sequence
  epitope peptide
SLLTEVCTPIRNEWC

SEQ ID NO: 1050 - protein, 13 aa, Artificial Sequence
  epitope peptide
SLLTEVECPIRNE

SEQ ID NO: 1051 - protein, 16 aa, Artificial Sequence
  epitope peptide
SLLTEVETPICNEWGC

SEQ ID NO: 1052 - protein, 32 aa, Artificial Sequence
  epitope peptide
SLLTEVETCSLLTEVETPIRNEWGSRSNDSSC

SEQ ID NO: 1053 - protein, 15 aa, Artificial Sequence
  epitope peptide
SLLTEVETPIRCEWG

SEQ ID NO: 1054 - protein, 15 aa, Artificial Sequence
  epitope peptide
SLCTEVETPIRNCWG

SEQ ID NO: 1055 - protein, 13 aa, Artificial Sequence
  epitope peptide
SLLTEVETCIRCE

SEQ ID NO: 1056 - protein, 15 aa, Artificial Sequence
  epitope peptide
SLLTECETPCRNEWG

SEQ ID NO: 1057 - protein, 15 aa, Artificial Sequence
  epitope peptide
SLLTEVETPICNEWG

SEQ ID NO: 1058 - protein, 22 aa, Artificial Sequence
  epitope peptide
SLLTEVETCSLLTEVETPIRNC

SEQ ID NO: 1059 - protein, 15 aa, Artificial Sequence
  epitope peptide
SLLTECETPICNEWG

SEQ ID NO: 1060 - protein, 15 aa, Artificial Sequence
  epitope peptide
SLLTECETPIRNEWG

SEQ ID NO: 1061 - protein, 15 aa, Artificial Sequence
  epitope peptide
SLLTEVETPCRCEWG

SEQ ID NO: 1062 - protein, 30 aa, Artificial Sequence
  epitope peptide
SLLTEVETCSLLTEVETPIRNEWGSRSNDC

SEQ ID NO: 1063 - protein, 15 aa, Artificial Sequence
  epitope peptide
SLLTECCTPIRNEWG

SEQ ID NO: 1064 - protein, 31 aa, Artificial Sequence
  epitope peptide
SLLTEVETCSLLTEVETPIRNEWGSRSNDSC

SEQ ID NO: 1065 - protein, 13 aa, Artificial Sequence
  epitope peptide
SLLTEVCTPCRNE

SEQ ID NO: 1066 - protein, 15 aa, Artificial Sequence
  epitope peptide
SCLTECETPIRNEWG

SEQ ID NO: 1067 - protein, 19 aa, Artificial Sequence
  epitope peptide
SLLTEVETCSLLTEVETPC

SEQ ID NO: 1068 - protein, 33 aa, Artificial Sequence
  epitope peptide
SLLTEVETCSLLTEVETPIRNEWGSRSNDSSDC

SEQ ID NO: 1069 - protein, 20 aa, Artificial Sequence
  epitope peptide
SLLTEVETCSLLTEVETPIC

SEQ ID NO: 1070 - protein, 18 aa, Artificial Sequence
  epitope peptide
SLLTEVETCSLLTEVETC

SEQ ID NO: 1071 - protein, 15 aa, Artificial Sequence
  epitope peptide
SLLTEVETPCRNEWG

SEQ ID NO: 1072 - protein, 17 aa, Artificial Sequence
  epitope peptide
CSLLTEVETPIRNEWGC

SEQ ID NO: 1073 - protein, 13 aa, Artificial Sequence
  epitope peptide
SLLTEVCTPIRCE

SEQ ID NO: 1074 - protein, 13 aa, Artificial Sequence
  epitope peptide
SLLTECETCIRNE

SEQ ID NO: 1075 - protein, 13 aa, Artificial Sequence
  epitope peptide
SCLTECETPIRNE

SEQ ID NO: 1076 - protein, 24 aa, Artificial Sequence
  epitope peptide
SLLTEVETCSLLTEVETPIRNEWC

SEQ ID NO: 1077 - protein, 15 aa, Artificial Sequence
  epitope peptide
SLLTEVETPCCNEWG

SEQ ID NO: 1078 - protein, 15 aa, Artificial Sequence
  epitope peptide
SLCTEVECPIRNEWG

SEQ ID NO: 1079 - protein, 15 aa, Artificial Sequence
  epitope peptide
SLCTEVETPIRCEWG

SEQ ID NO: 1080 - protein, 15 aa, Artificial Sequence
  epitope peptide
SLLTECETPIRNEWC

SEQ ID NO: 1081 - protein, 16 aa, Artificial Sequence
  epitope peptide
SLLTEVCTPIRNEWGC

SEQ ID NO: 1082 - protein, 15 aa, Artificial Sequence
  epitope peptide
SLLTEVETPIRCEWC

SEQ ID NO: 1083 - protein, 13 aa, Artificial Sequence
  epitope peptide
SCLTEVETCIRNE

SEQ ID NO: 1084 - protein, 13 aa, Artificial Sequence
  epitope peptide
SLLTEVETCICNE

SEQ ID NO: 1085 - protein, 15 aa, Artificial Sequence
  epitope peptide
SLLTEVETPICNEWC

SEQ ID NO: 1086 - protein, 16 aa, Artificial Sequence
  epitope peptide
SLLTEVECPIRNEWGC

SEQ ID NO: 1087 - protein, 13 aa, Artificial Sequence
  epitope peptide
SLCTEVETCIRNE

SEQ ID NO: 1088 - protein, 26 aa, Artificial Sequence
  epitope peptide
SLLTEVETCSLLTEVETPIRNEWGSC

SEQ ID NO: 1089 - protein, 30 aa, Artificial Sequence
  epitope peptide
SLLTEVETSLLTEVETPIRNEWGCRCNDSS

SEQ ID NO: 1090 - protein, 13 aa, Artificial Sequence
  epitope peptide
SCLTEVECPIRNE

SEQ ID NO: 1091 - protein, 13 aa, Artificial Sequence
  epitope peptide
SLLTEVCTPICNE

SEQ ID NO: 1092 - protein, 16 aa, Artificial Sequence
  epitope peptide
SLLTEVETPCRNEWGC

SEQ ID NO: 1093 - protein, 13 aa, Artificial Sequence
  epitope peptide
SLLTEVETCIRNE

SEQ ID NO: 1094 - protein, 15 aa, Artificial Sequence
  epitope peptide
SLLTEVCTPIRNECG

SEQ ID NO: 1095 - protein, 31 aa, Artificial Sequence
  epitope peptide
SLLTEVETSLLTEVETPIRNEWGCRCNDSSD

SEQ ID NO: 1096 - protein, 13 aa, Artificial Sequence
  epitope peptide
SLLTEVETPICNC

SEQ ID NO: 1097 - protein, 15 aa, Artificial Sequence
  epitope peptide
SCLTEVETPIRNCWG

SEQ ID NO: 1098 - protein, 15 aa, Artificial Sequence
  epitope peptide
SLLTEVETPICNECG

SEQ ID NO: 1099 - protein, 15 aa, Artificial Sequence
  epitope peptide
SLLTEVECPIRNECG

SEQ ID NO: 1100 - protein, 13 aa, Artificial Sequence
  epitope peptide
SLCTEVCTPIRNE

SEQ ID NO: 1101 - protein, 13 aa, Artificial Sequence
  epitope peptide
SLLTECETPIRCE

SEQ ID NO: 1102 - protein, 15 aa, Artificial Sequence
  epitope peptide
SLCTECETPIRNEWG

SEQ ID NO: 1103 - protein, 13 aa, Artificial Sequence
  epitope peptide
SLCTEVECPIRNE

SEQ ID NO: 1104 - protein, 13 aa, Artificial Sequence
  epitope peptide
SLLTECETPIRNC

SEQ ID NO: 1105 - protein, 15 aa, Artificial Sequence
  epitope peptide
SLCTEVCTPIRNEWG

SEQ ID NO: 1106 - protein, 15 aa, Artificial Sequence
  epitope peptide
SLLTEVETPIRNCCG

SEQ ID NO: 1107 - protein, 23 aa, Artificial Sequence
  epitope peptide
SLLTEVETCSLLTEVETPIRNEC

SEQ ID NO: 1108 - protein, 16 aa, Artificial Sequence
  epitope peptide
SLLTECETPIRNEWGC

SEQ ID NO: 1109 - protein, 15 aa, Artificial Sequence
  epitope peptide
SLCTEVETPCRNEWG

SEQ ID NO: 1110 - protein, 15 aa, Artificial Sequence
  epitope peptide
SLLTEVETPCRNEWC

SEQ ID NO: 1111 - protein, 15 aa, Artificial Sequence
  epitope peptide
SLLTEVETPCRNECG

SEQ ID NO: 1112 - protein, 13 aa, Artificial Sequence
  epitope peptide
SLLTEVECPICNE

SEQ ID NO: 1113 - protein, 13 aa, Artificial Sequence
  epitope peptide
SLLTECETPIRNE

SEQ ID NO: 1114 - protein, 15 aa, Artificial Sequence
  epitope peptide
SLCTEVETPICNEWG

SEQ ID NO: 1115 - protein, 13 aa, Artificial Sequence
  epitope peptide
SLLTEVETPCRNC

SEQ ID NO: 1116 - protein, 13 aa, Artificial Sequence
  epitope peptide
SLLTEVCTPIRNE

SEQ ID NO: 1117 - protein, 15 aa, Artificial Sequence
  epitope peptide
SLLTEVETPIRNEWC

SEQ ID NO: 1118 - protein, 15 aa, Artificial Sequence
  epitope peptide
SCLTEVECPIRNEWG

SEQ ID NO: 1119 - protein, 13 aa, Artificial Sequence
  epitope peptide
SLLTEVECPCRNE

SEQ ID NO: 1120 - protein, 13 aa, Artificial Sequence
  epitope peptide
SLCTEVETPCRNE

SEQ ID NO: 1121 - protein, 15 aa, Artificial Sequence
  epitope peptide
SLCTEVETPIRNEWC

SEQ ID NO: 1122 - protein, 13 aa, Artificial Sequence
  epitope peptide
SLLTECETPICNE

SEQ ID NO: 1123 - protein, 15 aa, Artificial Sequence
  epitope peptide
SLLTECETPIRNECG

SEQ ID NO: 1124 - protein, 15 aa, Artificial Sequence
  epitope peptide
SLCTEVETPIRNEWG

SEQ ID NO: 1125 - protein, 13 aa, Artificial Sequence
  epitope peptide
SLLTECECPIRNE

SEQ ID NO: 1126 - protein, 15 aa, Artificial Sequence
  epitope peptide
CMSLLTEVETPIRNC

SEQ ID NO: 1127 - protein, 20 aa, Artificial Sequence
  epitope peptide
MSLLTEVEKPIRNEWGCRCN

SEQ ID NO: 1128 - protein, 14 aa, Artificial Sequence
  epitope peptide
MSLLTEVETPCRNC

SEQ ID NO: 1129 - protein, 14 aa, Artificial Sequence
  epitope peptide
MSLLTEVECPIRNC

SEQ ID NO: 1130 - protein, 14 aa, Artificial Sequence
  epitope peptide
MSLLTEVCTPIRNC

SEQ ID NO: 1131 - protein, 20 aa, Artificial Sequence
  epitope peptide
DSLLTEVETPIRNEWGCRCN

SEQ ID NO: 1132 - protein, 20 aa, Artificial Sequence
  epitope peptide
MSLLTEVETPIRNEAGCRCN

SEQ ID NO: 1133 - protein, 14 aa, Artificial Sequence
  epitope peptide
MSLLTEVETPCRCE

SEQ ID NO: 1134 - protein, 14 aa, Artificial Sequence
  epitope peptide
MSLLTEVETPCRNE

SEQ ID NO: 1135 - protein, 20 aa, Artificial Sequence
  epitope peptide
MSLLTEVEMPIRNEWGCRCN

SEQ ID NO: 1136 - protein, 20 aa, Artificial Sequence
  epitope peptide
MSLLTEVEAPIRNEWGCRCN

SEQ ID NO: 1137 - protein, 20 aa, Artificial Sequence
  epitope peptide
MSLLTEVELPIRNEWGCRCN

SEQ ID NO: 1138 - protein, 20 aa, Artificial Sequence
  epitope peptide
MSLLTELETPIRNEWGCRCN

SEQ ID NO: 1139 - protein, 20 aa, Artificial Sequence
  epitope peptide
MSLLTEVETPIRNAWGCRCN

SEQ ID NO: 1140 - protein, 20 aa, Artificial Sequence
  epitope peptide
MSLTTEVETPIRNEWGCRCN

SEQ ID NO: 1141 - protein, 20 aa, Artificial Sequence
  epitope peptide
MTLLTEVETPIRNEWGCRCN

SEQ ID NO: 1142 - protein, 14 aa, Artificial Sequence
  epitope peptide
MSLLTEVETPICNC

SEQ ID NO: 1143 - protein, 14 aa, Artificial Sequence
  epitope peptide
MSLLTEVCTPIRCE

SEQ ID NO: 1144 - protein, 20 aa, Artificial Sequence
  epitope peptide
MSLLTEVETAIRNEWGCRCN

SEQ ID NO: 1145 - protein, 14 aa, Artificial Sequence
  epitope peptide
MSLCTEVETPIRNC

SEQ ID NO: 1146 - protein, 14 aa, Artificial Sequence
  epitope peptide
MSLLTEVETCIRNE

SEQ ID NO: 1147 - protein, 14 aa, Artificial Sequence
  epitope peptide
MSLLTEVETCICNE

SEQ ID NO: 1148 - protein, 20 aa, Artificial Sequence
  epitope peptide
MSLLTEVEEPIRNEWGCRCN

SEQ ID NO: 1149 - protein, 20 aa, Artificial Sequence
  epitope peptide
MSLLTEVETPIRNEWGCRCN

SEQ ID NO: 1150 - protein, 20 aa, Artificial Sequence
  epitope peptide
MSLLTEVEQPIRNEWGCRCN

SEQ ID NO: 1151 - protein, 14 aa, Artificial Sequence
  epitope peptide
MSLLTEVECPIRCE

SEQ ID NO: 1152 - protein, 20 aa, Artificial Sequence
  epitope peptide
MSLLTEKETPIRNEWGCRCN

SEQ ID NO: 1153 - protein, 20 aa, Artificial Sequence
  epitope peptide
ESLLTEVETPIRNEWGCRCN

SEQ ID NO: 1154 - protein, 14 aa, Artificial Sequence
  epitope peptide
MSLCTEVETCIRNE

SEQ ID NO: 1155 - protein, 20 aa, Artificial Sequence
  epitope peptide
MSLLTETETPIRNEWGCRCN

SEQ ID NO: 1156 - protein, 20 aa, Artificial Sequence
  epitope peptide
MSLLTEIETPIRNEWGCRCN

SEQ ID NO: 1157 - protein, 20 aa, Artificial Sequence
  epitope peptide
MSLLTEVETPIRNEWGCRAN

SEQ ID NO: 1158 - protein, 14 aa, Artificial Sequence
  epitope peptide
MSLLTEVCTPCRNE

SEQ ID NO: 1159 - protein, 20 aa, Artificial Sequence
  epitope peptide
TSLLTEVETPIRNEWGCRCN

SEQ ID NO: 1160 - protein, 14 aa, Artificial Sequence
  epitope peptide
MSLCTEVCTPIRNE

SEQ ID NO: 1161 - protein, 20 aa, Artificial Sequence
  epitope peptide
MSLLTEVETPIRNEWGCRCA

SEQ ID NO: 1162 - protein, 20 aa, Artificial Sequence
  epitope peptide
MSLVTEVETPIRNEWGCRCN

SEQ ID NO: 1163 - protein, 14 aa, Artificial Sequence
  epitope peptide
MSCLTEVETPIRCE

SEQ ID NO: 1164 - protein, 20 aa, Artificial Sequence
  epitope peptide
MSLATEVETPIRNEWGCRCN

SEQ ID NO: 1165 - protein, 20 aa, Artificial Sequence
  epitope peptide
MSLLTEVVTPIRNEWGCRCN

SEQ ID NO: 1166 - protein, 20 aa, Artificial Sequence
  epitope peptide
MSLLTEVQTPIRNEWGCRCN

SEQ ID NO: 1167 - protein, 20 aa, Artificial Sequence
  epitope peptide
MSLITEVETPIRNEWGCRCN

SEQ ID NO: 1168 - protein, 14 aa, Artificial Sequence
  epitope peptide
MSLLTEVECPIRNE

SEQ ID NO: 1169 - protein, 14 aa, Artificial Sequence
  epitope peptide
MSLLTEVCTPICNE

SEQ ID NO: 1170 - protein, 20 aa, Artificial Sequence
  epitope peptide
MSLLTEPETPIRNEWGCRCN

SEQ ID NO: 1171 - protein, 20 aa, Artificial Sequence
  epitope peptide
MSLLTEVEFPIRNEWGCRCN

SEQ ID NO: 1172 - protein, 20 aa, Artificial Sequence
  epitope peptide
MSLLTEVETPARNEWGCRCN

SEQ ID NO: 1173 - protein, 20 aa, Artificial Sequence
  epitope peptide
MSLLTEVETPIRNEWGARCN

SEQ ID NO: 1174 - protein, 20 aa, Artificial Sequence
  epitope peptide
MSLLTEVMTPIRNEWGCRCN

SEQ ID NO: 1175 - protein, 14 aa, Artificial Sequence
  epitope peptide
MSLLTECETPIRCE

SEQ ID NO: 1176 - protein, 15 aa, Artificial Sequence
  epitope peptide
CMSLLTEVECPIRNE

SEQ ID NO: 1177 - protein, 20 aa, Artificial Sequence
  epitope peptide
ASLLTEVETPIRNEWGCRCN

SEQ ID NO: 1178 - protein, 14 aa, Artificial Sequence
  epitope peptide
MSLLTEVETCIRCE

SEQ ID NO: 1179 - protein, 14 aa, Artificial Sequence
  epitope peptide
MSCLTEVETPIRNC

SEQ ID NO: 1180 - protein, 20 aa, Artificial Sequence
  epitope peptide
MSLLTEVEGPIRNEWGCRCN

SEQ ID NO: 1181 - protein, 20 aa, Artificial Sequence
  epitope peptide
MSLLTEVETPIRNEWACRCN

SEQ ID NO: 1182 - protein, 20 aa, Artificial Sequence
  epitope peptide
MSLLTEMETPIRNEWGCRCN

SEQ ID NO: 1183 - protein, 20 aa, Artificial Sequence
  epitope peptide
KSLLTEVETPIRNEWGCRCN

SEQ ID NO: 1184 - protein, 20 aa, Artificial Sequence
  epitope peptide
MSLLTEVEVPIRNEWGCRCN

SEQ ID NO: 1185 - protein, 14 aa, Artificial Sequence
  epitope peptide
MSLCTEVETPCRNE

SEQ ID NO: 1186 - protein, 14 aa, Artificial Sequence
  epitope peptide
MSCLTEVCTPIRNE

SEQ ID NO: 1187 - protein, 15 aa, Artificial Sequence
  epitope peptide
CMSLLTEVCTPIRNE

SEQ ID NO: 1188 - protein, 20 aa, Artificial Sequence
  epitope peptide
VSLLTEVETPIRNEWGCRCN

SEQ ID NO: 1189 - protein, 20 aa, Artificial Sequence
  epitope peptide
MSLLTEVESPIRNEWGCRCN

SEQ ID NO: 1190 - protein, 20 aa, Artificial Sequence
  epitope peptide
MSLLTEVSTPIRNEWGCRCN

SEQ ID NO: 1191 - protein, 20 aa, Artificial Sequence
  epitope peptide
MSLLTEFETPIRNEWGCRCN

SEQ ID NO: 1192 - protein, 15 aa, Artificial Sequence
  epitope peptide
CMSLLTEVETPIRCE

SEQ ID NO: 1193 - protein, 14 aa, Artificial Sequence
  epitope peptide
MSLCTEVECPIRNE

SEQ ID NO: 1194 - protein, 14 aa, Artificial Sequence
  epitope peptide
MSLLTECETPICNE

SEQ ID NO: 1195 - protein, 20 aa, Artificial Sequence
  epitope peptide
MSLLTEVTTPIRNEWGCRCN

SEQ ID NO: 1196 - protein, 20 aa, Artificial Sequence
  epitope peptide
RSLLTEVETPIRNEWGCRCN

SEQ ID NO: 1197 - protein, 20 aa, Artificial Sequence
  epitope peptide
MSLLTEVEDPIRNEWGCRCN

SEQ ID NO: 1198 - protein, 20 aa, Artificial Sequence
  epitope peptide
MSLLTEAETPIRNEWGCRCN

SEQ ID NO: 1199 - protein, 15 aa, Artificial Sequence
  epitope peptide
CMSLLTEVETPCRNE

SEQ ID NO: 1200 - protein, 20 aa, Artificial Sequence
  epitope peptide
MSLLTEVETPIRAEWGCRCN

SEQ ID NO: 1201 - protein, 14 aa, Artificial Sequence
  epitope peptide
MSLLTEVCTCIRNE

SEQ ID NO: 1202 - protein, 14 aa, Artificial Sequence
  epitope peptide
MSLLTECECPIRNE

SEQ ID NO: 1203 - protein, 20 aa, Artificial Sequence
  epitope peptide
HSLLTEVETPIRNEWGCRCN

SEQ ID NO: 1204 - protein, 15 aa, Artificial Sequence
  epitope peptide
CMSLLTECETPIRNE

SEQ ID NO: 1205 - protein, 20 aa, Artificial Sequence
  epitope peptide
MSLLTEVENPIRNEWGCRCN

SEQ ID NO: 1206 - protein, 14 aa, Artificial Sequence
  epitope peptide
MSLLTECETPCRNE

SEQ ID NO: 1207 - protein, 20 aa, Artificial Sequence
  epitope peptide
MSLLTEVERPIRNEWGCRCN

SEQ ID NO: 1208 - protein, 20 aa, Artificial Sequence
  epitope peptide
MSLLTEQETPIRNEWGCRCN

SEQ ID NO: 1209 - protein, 14 aa, Artificial Sequence
  epitope peptide
MSLLTEVETCIRNC

SEQ ID NO: 1210 - protein, 20 aa, Artificial Sequence
  epitope peptide
MSFLTEVETPIRNEWGCRCN

SEQ ID NO: 1211 - protein, 15 aa, Artificial Sequence
  epitope peptide
CMSLLTEVETCIRNE

SEQ ID NO: 1212 - protein, 20 aa, Artificial Sequence
  epitope peptide
PSLLTEVETPIRNEWGCRCN

SEQ ID NO: 1213 - protein, 20 aa, Artificial Sequence
  epitope peptide
MSLETEVETPIRNEWGCRCN

SEQ ID NO: 1214 - protein, 20 aa, Artificial Sequence
  epitope peptide
MSLLTEVEHPIRNEWGCRCN

SEQ ID NO: 1215 - protein, 20 aa, Artificial Sequence
  epitope peptide
YSLLTEVETPIRNEWGCRCN

SEQ ID NO: 1216 - protein, 14 aa, Artificial Sequence
  epitope peptide
MSLLTEVCTPIRNE

SEQ ID NO: 1217 - protein, 14 aa, Artificial Sequence
  epitope peptide
MSLLTEVECPICNE

SEQ ID NO: 1218 - protein, 20 aa, Artificial Sequence
  epitope peptide
MSLLTEVETPIANEWGCRCN

SEQ ID NO: 1219 - protein, 20 aa, Artificial Sequence
  epitope peptide
LSLLTEVETPIRNEWGCRCN

SEQ ID NO: 1220 - protein, 20 aa, Artificial Sequence
  epitope peptide
WSLLTEVETPIRNEWGCRCN

SEQ ID NO: 1221 - protein, 20 aa, Artificial Sequence
  epitope peptide
MSLLTEVETPIRNEWGCACN

SEQ ID NO: 1222 - protein, 14 aa, Artificial Sequence
  epitope peptide
MSLLTEVECPCRNE

SEQ ID NO: 1223 - protein, 14 aa, Artificial Sequence
  epitope peptide
MSCLTEVECPIRNE

SEQ ID NO: 1224 - protein, 20 aa, Artificial Sequence
  epitope peptide
FSLLTEVETPIRNEWGCRCN

SEQ ID NO: 1225 - protein, 20 aa, Artificial Sequence
  epitope peptide
NSLLTEVETPIRNEWGCRCN

SEQ ID NO: 1226 - protein, 20 aa, Artificial Sequence
  epitope peptide
MSLLTEVEYPIRNEWGCRCN

SEQ ID NO: 1227 - protein, 20 aa, Artificial Sequence
  epitope peptide
MSLLTDVETPIRNEWGCRCN

SEQ ID NO: 1228 - protein, 20 aa, Artificial Sequence
  epitope peptide
MSKLTEVETPIRNEWGCRCN

SEQ ID NO: 1229 - protein, 14 aa, Artificial Sequence
  epitope peptide
MSCLTEVETCIRNE

SEQ ID NO: 1230 - protein, 20 aa, Artificial Sequence
  epitope peptide
MSLSTEVETPIRNEWGCRCN

SEQ ID NO: 1231 - protein, 14 aa, Artificial Sequence
  epitope peptide
MSLLTECETPIRNE

SEQ ID NO: 1232 - protein, 20 aa, Artificial Sequence
  epitope peptide
ISLLTEVETPIRNEWGCRCN

SEQ ID NO: 1233 - protein, 14 aa, Artificial Sequence
  epitope peptide
MSCLTEVETPCRNE

SEQ ID NO: 1234 - protein, 14 aa, Artificial Sequence
  epitope peptide
MSLCTEVETPIRNE

SEQ ID NO: 1235 - protein, 15 aa, Artificial Sequence
  epitope peptide
CMSLLTEVETPICNE

SEQ ID NO: 1236 - protein, 20 aa, Artificial Sequence
  epitope peptide
MSLLTEVEPPIRNEWGCRCN

SEQ ID NO: 1237 - protein, 14 aa, Artificial Sequence
  epitope peptide
MSCLTEVETPIRNE

SEQ ID NO: 1238 - protein, 20 aa, Artificial Sequence
  epitope peptide
GSLLTEVETPIRNEWGCRCN

SEQ ID NO: 1239 - protein, 14 aa, Artificial Sequence
  epitope peptide
MSLCTEVETPIRCE

SEQ ID NO: 1240 - protein, 20 aa, Artificial Sequence
  epitope peptide
MSLKTEVETPIRNEWGCRCN

SEQ ID NO: 1241 - protein, 20 aa, Artificial Sequence
  epitope peptide
MSLLTEEETPIRNEWGCRCN

SEQ ID NO: 1242 - protein, 14 aa, Artificial Sequence
  epitope peptide
CSLCTEVETPIRNE

SEQ ID NO: 1243 - protein, 20 aa, Artificial Sequence
  epitope peptide
QSLLTEVETPIRNEWGCRCN

SEQ ID NO: 1244 - protein, 20 aa, Artificial Sequence
  epitope peptide
MSLLTEVEIPIRNEWGCRCN

SEQ ID NO: 1245 - protein, 20 aa, Artificial Sequence
  epitope peptide
MSLLTESETPIRNEWGCRCN

SEQ ID NO: 1246 - protein, 20 aa, Artificial Sequence
  epitope peptide
MSLLTEGETPIRNEWGCRCN

SEQ ID NO: 1247 - protein, 14 aa, Artificial Sequence
  epitope peptide
MSLLTECETPIRNC

SEQ ID NO: 1248 - protein, 14 aa, Artificial Sequence
  epitope peptide
MSLLTECETCIRNE

SEQ ID NO: 1249 - protein, 20 aa, Artificial Sequence
  epitope peptide
SSLLTEVETPIRNEWGCRCN

SEQ ID NO: 1250 - protein, 20 aa, Artificial Sequence
  epitope peptide
MALLTEVETPIRNEWGCRCN

SEQ ID NO: 1251 - protein, 20 aa, Artificial Sequence
  epitope peptide
MDLLTEVETPIRNEWGCRCN

SEQ ID NO: 1252 - protein, 20 aa, Artificial Sequence
  epitope peptide
MELLTEVETPIRNEWGCRCN

SEQ ID NO: 1253 - protein, 20 aa, Artificial Sequence
  epitope peptide
MFLLTEVETPIRNEWGCRCN

SEQ ID NO: 1254 - protein, 20 aa, Artificial Sequence
  epitope peptide
MGLLTEVETPIRNEWGCRCN

SEQ ID NO: 1255 - protein, 20 aa, Artificial Sequence
  epitope peptide
MHLLTEVETPIRNEWGCRCN

SEQ ID NO: 1256 - protein, 20 aa, Artificial Sequence
  epitope peptide
MILLTEVETPIRNEWGCRCN

SEQ ID NO: 1257 - protein, 20 aa, Artificial Sequence
  epitope peptide
MKLLTEVETPIRNEWGCRCN

SEQ ID NO: 1258 - protein, 20 aa, Artificial Sequence
  epitope peptide
MLLLTEVETPIRNEWGCRCN

SEQ ID NO: 1259 - protein, 20 aa, Artificial Sequence
  epitope peptide
MMLLTEVETPIRNEWGCRCN

SEQ ID NO: 1260 - protein, 20 aa, Artificial Sequence
  epitope peptide
MNLLTEVETPIRNEWGCRCN

SEQ ID NO: 1261 - protein, 20 aa, Artificial Sequence
  epitope peptide
MPLLTEVETPIRNEWGCRCN

SEQ ID NO: 1262 - protein, 20 aa, Artificial Sequence
  epitope peptide
MQLLTEVETPIRNEWGCRCN

SEQ ID NO: 1263 - protein, 20 aa, Artificial Sequence
  epitope peptide
MRLLTEVETPIRNEWGCRCN

SEQ ID NO: 1264 - protein, 20 aa, Artificial Sequence
  epitope peptide
MVLLTEVETPIRNEWGCRCN

SEQ ID NO: 1265 - protein, 20 aa, Artificial Sequence
  epitope peptide
MWLLTEVETPIRNEWGCRCN

SEQ ID NO: 1266 - protein, 20 aa, Artificial Sequence
  epitope peptide
MYLLTEVETPIRNEWGCRCN

SEQ ID NO: 1267 - protein, 20 aa, Artificial Sequence
  epitope peptide
MSILTEVETPIRNEWGCRCN

SEQ ID NO: 1268 - protein, 20 aa, Artificial Sequence
  epitope peptide
MSMLTEVETPIRNEWGCRCN

SEQ ID NO: 1269 - protein, 20 aa, Artificial Sequence
  epitope peptide
MSVLTEVETPIRNEWGCRCN

SEQ ID NO: 1270 - protein, 20 aa, Artificial Sequence
  epitope peptide
MSLDTEVETPIRNEWGCRCN

SEQ ID NO: 1271 - protein, 20 aa, Artificial Sequence
  epitope peptide
MSLFTEVETPIRNEWGCRCN

SEQ ID NO: 1272 - protein, 20 aa, Artificial Sequence
  epitope peptide
MSLHTEVETPIRNEWGCRCN

SEQ ID NO: 1273 - protein, 20 aa, Artificial Sequence
  epitope peptide
MSLMTEVETPIRNEWGCRCN

SEQ ID NO: 1274 - protein, 20 aa, Artificial Sequence
  epitope peptide
MSLNTEVETPIRNEWGCRCN

SEQ ID NO: 1275 - protein, 20 aa, Artificial Sequence
  epitope peptide
MSLPTEVETPIRNEWGCRCN

SEQ ID NO: 1276 - protein, 20 aa, Artificial Sequence
  epitope peptide
MSLQTEVETPIRNEWGCRCN

SEQ ID NO: 1277 - protein, 20 aa, Artificial Sequence
  epitope peptide
MSLRTEVETPIRNEWGCRCN

SEQ ID NO: 1278 - protein, 20 aa, Artificial Sequence
  epitope peptide
MSLYTEVETPIRNEWGCRCN

SEQ ID NO: 1279 - protein, 20 aa, Artificial Sequence
  epitope peptide
MSLLAEVETPIRNEWGCRCN

SEQ ID NO: 1280 - protein, 20 aa, Artificial Sequence
  epitope peptide
MSLLDEVETPIRNEWGCRCN

SEQ ID NO: 1281 - protein, 20 aa, Artificial Sequence
  epitope peptide
MSLLEEVETPIRNEWGCRCN

SEQ ID NO: 1282 - protein, 20 aa, Artificial Sequence
  epitope peptide
MSLLFEVETPIRNEWGCRCN

SEQ ID NO: 1283 - protein, 20 aa, Artificial Sequence
  epitope peptide
MSLLGEVETPIRNEWGCRCN

SEQ ID NO: 1284 - protein, 20 aa, Artificial Sequence
  epitope peptide
MSLLHEVETPIRNEWGCRCN

SEQ ID NO: 1285 - protein, 20 aa, Artificial Sequence
  epitope peptide
MSLLIEVETPIRNEWGCRCN

SEQ ID NO: 1286 - protein, 20 aa, Artificial Sequence
  epitope peptide
MSLLKEVETPIRNEWGCRCN

SEQ ID NO: 1287 - protein, 20 aa, Artificial Sequence
  epitope peptide
MSLLLEVETPIRNEWGCRCN

SEQ ID NO: 1288 - protein, 20 aa, Artificial Sequence
  epitope peptide
MSLLMEVETPIRNEWGCRCN

SEQ ID NO: 1289 - protein, 20 aa, Artificial Sequence
  epitope peptide
MSLLNEVETPIRNEWGCRCN

SEQ ID NO: 1290 - protein, 20 aa, Artificial Sequence
  epitope peptide
MSLLPEVETPIRNEWGCRCN

SEQ ID NO: 1291 - protein, 20 aa, Artificial Sequence
  epitope peptide
MSLLQEVETPIRNEWGCRCN

SEQ ID NO: 1292 - protein, 20 aa, Artificial Sequence
  epitope peptide
MSLLREVETPIRNEWGCRCN

SEQ ID NO: 1293 - protein, 20 aa, Artificial Sequence
  epitope peptide
MSLLSEVETPIRNEWGCRCN

SEQ ID NO: 1294 - protein, 20 aa, Artificial Sequence
  epitope peptide
MSLLVEVETPIRNEWGCRCN

SEQ ID NO: 1295 - protein, 20 aa, Artificial Sequence
  epitope peptide
MSLLWEVETPIRNEWGCRCN

SEQ ID NO: 1296 - protein, 20 aa, Artificial Sequence
  epitope peptide
MSLLYEVETPIRNEWGCRCN

SEQ ID NO: 1297 - protein, 20 aa, Artificial Sequence
  epitope peptide
MSLLTQVETPIRNEWGCRCN

SEQ ID NO: 1298 - protein, 20 aa, Artificial Sequence
  epitope peptide
MSLLTTVETPIRNEWGCRCN

SEQ ID NO: 1299 - protein, 20 aa, Artificial Sequence
  epitope peptide
MSLLTEVATPIRNEWGCRCN

SEQ ID NO: 1300 - protein, 20 aa, Artificial Sequence
  epitope peptide
MSLLTEVDTPIRNEWGCRCN

SEQ ID NO: 1301 - protein, 20 aa, Artificial Sequence
  epitope peptide
MSLLTEVFTPIRNEWGCRCN

SEQ ID NO: 1302 - protein, 20 aa, Artificial Sequence
  epitope peptide
MSLLTEVGTPIRNEWGCRCN

SEQ ID NO: 1303 - protein, 20 aa, Artificial Sequence
  epitope peptide
MSLLTEVHTPIRNEWGCRCN

SEQ ID NO: 1304 - protein, 20 aa, Artificial Sequence
  epitope peptide
MSLLTEVITPIRNEWGCRCN

SEQ ID NO: 1305 - protein, 20 aa, Artificial Sequence
  epitope peptide
MSLLTEVKTPIRNEWGCRCN

SEQ ID NO: 1306 - protein, 20 aa, Artificial Sequence
  epitope peptide
MSLLTEVLTPIRNEWGCRCN

SEQ ID NO: 1307 - protein, 20 aa, Artificial Sequence
  epitope peptide
MSLLTEVNTPIRNEWGCRCN

SEQ ID NO: 1308 - protein, 20 aa, Artificial Sequence
  epitope peptide
MSLLTEVPTPIRNEWGCRCN

SEQ ID NO: 1309 - protein, 20 aa, Artificial Sequence
  epitope peptide
MSLLTEVRTPIRNEWGCRCN

SEQ ID NO: 1310 - protein, 20 aa, Artificial Sequence
  epitope peptide
MSLLTEVWTPIRNEWGCRCN

SEQ ID NO: 1311 - protein, 20 aa, Artificial Sequence
  epitope peptide
MSLLTEVYTPIRNEWGCRCN

SEQ ID NO: 1312 - protein, 20 aa, Artificial Sequence
  epitope peptide
MSLLTEVEWPIRNEWGCRCN

SEQ ID NO: 1313 - protein, 15 aa, Artificial Sequence
  epitope peptide
CMSLLCEVETPIRNE

SEQ ID NO: 1314 - protein, 15 aa, Artificial Sequence
  epitope peptide
CMSLCTEVETPIRNE

SEQ ID NO: 1315 - protein, 15 aa, Artificial Sequence
  epitope peptide
CMCLLTEVETPIRNE

SEQ ID NO: 1316 - protein, 14 aa, Artificial Sequence
  epitope peptide
CSLLCEVETPIRNE

SEQ ID NO: 1317 - protein, 14 aa, Artificial Sequence
  epitope peptide
MCLLTEVETPIRNC

SEQ ID NO: 1318 - protein, 14 aa, Artificial Sequence
  epitope peptide
MCLLTEVETPIRCE

SEQ ID NO: 1319 - protein, 14 aa, Artificial Sequence
  epitope peptide
MCLLTEVETPICNE

SEQ ID NO: 1320 - protein, 14 aa, Artificial Sequence
  epitope peptide
MCLLTEVETPCRNE

SEQ ID NO: 1321 - protein, 14 aa, Artificial Sequence
  epitope peptide
MCLLTEVETCIRNE

SEQ ID NO: 1322 - protein, 14 aa, Artificial Sequence
  epitope peptide
MCLLTEVECPIRNE

SEQ ID NO: 1323 - protein, 14 aa, Artificial Sequence
  epitope peptide
MCLLTEVCTPIRNE

SEQ ID NO: 1324 - protein, 14 aa, Artificial Sequence
  epitope peptide
MCLLCEVETPIRNE

SEQ ID NO: 1325 - protein, 14 aa, Artificial Sequence
  epitope peptide
MSLLCEVETPIRNC

SEQ ID NO: 1326 - protein, 14 aa, Artificial Sequence
  epitope peptide
MSLLCEVETPIRCE

SEQ ID NO: 1327 - protein, 14 aa, Artificial Sequence
  epitope peptide
MSLLCEVETPICNE

SEQ ID NO: 1328 - protein, 14 aa, Artificial Sequence
  epitope peptide
MSLLCEVETPCRNE

SEQ ID NO: 1329 - protein, 14 aa, Artificial Sequence
  epitope peptide
MSLLCEVETCIRNE

SEQ ID NO: 1330 - protein, 14 aa, Artificial Sequence
  epitope peptide
MSLLCEVECPIRNE

SEQ ID NO: 1331 - protein, 14 aa, Artificial Sequence
  epitope peptide
MSLLCEVCTPIRNE

SEQ ID NO: 1332 - protein, 14 aa, Artificial Sequence
  epitope peptide
MCLLTEVETPIRNE

SEQ ID NO: 1333 - protein, 14 aa, Artificial Sequence
  epitope peptide
MSLLCEVETPIRNE

SEQ ID NO: 1334 - protein, 15 aa, Artificial Sequence
  epitope peptide
MSLLCEVGMCLLTEV

SEQ ID NO: 1335 - protein, 15 aa, Artificial Sequence
  epitope peptide
MCLLTEVGMSCLTEV

SEQ ID NO: 1336 - protein, 15 aa, Artificial Sequence
  epitope peptide
MSLLCEVGMSCLTEV

SEQ ID NO: 1337 - protein, 15 aa, Artificial Sequence
  epitope peptide
MCLLTEVGMSLCTEV

SEQ ID NO: 1338 - protein, 15 aa, Artificial Sequence
  epitope peptide
MSLLCEVGMSLCTEV

SEQ ID NO: 1339 - protein, 15 aa, Artificial Sequence
  epitope peptide
MCLLTEVGMSLLCEV

SEQ ID NO: 1340 - protein, 15 aa, Artificial Sequence
  epitope peptide
MSCLTEVGMSLLCEV

SEQ ID NO: 1341 - protein, 15 aa, Artificial Sequence
  epitope peptide
MSLLCEVGMSLLCEV

SEQ ID NO: 1342 - protein, 15 aa, Artificial Sequence
  epitope peptide
MSLLTCVGMSLLCEV

SEQ ID NO: 1343 - protein, 15 aa, Artificial Sequence
  epitope peptide
CSCLCEVGMSLLCEV

SEQ ID NO: 1344 - protein, 15 aa, Artificial Sequence
  epitope peptide
MCLCTCVGMSLLCEV

SEQ ID NO: 1345 - protein, 15 aa, Artificial Sequence
  epitope peptide
MSCLCECGMSLLCEV

SEQ ID NO: 1346 - protein, 15 aa, Artificial Sequence
  epitope peptide
MCLLTEVGMSLLTCV

SEQ ID NO: 1347 - protein, 15 aa, Artificial Sequence
  epitope peptide
MSLLCEVGMSLLTCV

SEQ ID NO: 1348 - protein, 15 aa, Artificial Sequence
  epitope peptide
MSLCTEVGCSCLCEV

SEQ ID NO: 1349 - protein, 15 aa, Artificial Sequence
  epitope peptide
MSLLCEVGCSCLCEV

SEQ ID NO: 1350 - protein, 15 aa, Artificial Sequence
  epitope peptide
MSLLCEVGMCLCTCV

SEQ ID NO: 1351 - protein, 15 aa, Artificial Sequence
  epitope peptide
MSLLCEVGMSCLCEC

SEQ ID NO: 1352 - protein, 14 aa, Artificial Sequence
  epitope peptide
CCLLTEVETPIRNE

SEQ ID NO: 1353 - protein, 13 aa, Artificial Sequence
  epitope peptide
CLLTEVETPIRNC

SEQ ID NO: 1354 - protein, 13 aa, Artificial Sequence
  epitope peptide
CLLTEVETPIRCE

SEQ ID NO: 1355 - protein, 13 aa, Artificial Sequence
  epitope peptide
CLLTEVETPICNE

SEQ ID NO: 1356 - protein, 13 aa, Artificial Sequence
  epitope peptide
CLLTEVETPCRNE

SEQ ID NO: 1357 - protein, 13 aa, Artificial Sequence
  epitope peptide
CLLTEVETCIRNE

SEQ ID NO: 1358 - protein, 13 aa, Artificial Sequence
  epitope peptide
CLLTEVECPIRNE

SEQ ID NO: 1359 - protein, 13 aa, Artificial Sequence
  epitope peptide
CLLTEVCTPIRNE

SEQ ID NO: 1360 - protein, 13 aa, Artificial Sequence
  epitope peptide
CLLCEVETPIRNE

SEQ ID NO: 1361 - protein, 13 aa, Artificial Sequence
  epitope peptide
SLLCEVETPIRNC

SEQ ID NO: 1362 - protein, 13 aa, Artificial Sequence
  epitope peptide
SLLCEVETPIRCE

SEQ ID NO: 1363 - protein, 13 aa, Artificial Sequence
  epitope peptide
SLLCEVETPICNE

SEQ ID NO: 1364 - protein, 13 aa, Artificial Sequence
  epitope peptide
SLLCEVETPCRNE

SEQ ID NO: 1365 - protein, 13 aa, Artificial Sequence
  epitope peptide
SLLCEVETCIRNE

SEQ ID NO: 1366 - protein, 13 aa, Artificial Sequence
  epitope peptide
SLLCEVECPIRNE

SEQ ID NO: 1367 - protein, 13 aa, Artificial Sequence
  epitope peptide
SLLCEVCTPIRNE

SEQ ID NO: 1368 - protein, 13 aa, Artificial Sequence
  epitope peptide
SLLTEVETPCRNE

SEQ ID NO: 1369 - protein, 13 aa, Artificial Sequence
  epitope peptide
SLLTEVETPCRCE

SEQ ID NO: 1370 - protein, 13 aa, Artificial Sequence
  epitope peptide
CLLTEVETPIRNE

SEQ ID NO: 1371 - protein, 13 aa, Artificial Sequence
  epitope peptide
SLLCEVETPIRNE

SEQ ID NO: 1372 - protein, 16 aa, Artificial Sequence
  epitope peptide
CLLTEVETPIRNEWGC

SEQ ID NO: 1373 - protein, 16 aa, Artificial Sequence
  epitope peptide
SLLCEVETPIRNEWGC

SEQ ID NO: 1374 - protein, 16 aa, Artificial Sequence
  epitope peptide
SLLTEVETPIRNECGC

SEQ ID NO: 1375 - protein, 16 aa, Artificial Sequence
  epitope peptide
SLLTEVETPIRNEWCC

SEQ ID NO: 1376 - protein, 15 aa, Artificial Sequence
  epitope peptide
CLLTEVETPIRNEWC

SEQ ID NO: 1377 - protein, 15 aa, Artificial Sequence
  epitope peptide
CLLTEVETPIRNECG

SEQ ID NO: 1378 - protein, 15 aa, Artificial Sequence
  epitope peptide
CLLTEVETPIRNCWG

SEQ ID NO: 1379 - protein, 15 aa, Artificial Sequence
  epitope peptide
CLLTEVETPIRCEWG

SEQ ID NO: 1380 - protein, 15 aa, Artificial Sequence
  epitope peptide
CLLTEVETPICNEWG

SEQ ID NO: 1381 - protein, 15 aa, Artificial Sequence
  epitope peptide
CLLTEVETPCRNEWG

SEQ ID NO: 1382 - protein, 15 aa, Artificial Sequence
  epitope peptide
CLLTEVETCIRNEWG

SEQ ID NO: 1383 - protein, 15 aa, Artificial Sequence
  epitope peptide
CLLTEVECPIRNEWG

SEQ ID NO: 1384 - protein, 15 aa, Artificial Sequence
  epitope peptide
CLLCEVETPIRNEWG

SEQ ID NO: 1385 - protein, 15 aa, Artificial Sequence
  epitope peptide
CLLTEVETPIRNEWG

SEQ ID NO: 1386 - protein, 15 aa, Artificial Sequence
  epitope peptide
SLCCEVETPIRNEWG

SEQ ID NO: 1387 - protein, 15 aa, Artificial Sequence
  epitope peptide
SLLCEVETPIRNEWC

SEQ ID NO: 1388 - protein, 15 aa, Artificial Sequence
  epitope peptide
SLLCEVETPIRNECG

SEQ ID NO: 1389 - protein, 15 aa, Artificial Sequence
  epitope peptide
SLLCEVETPIRNCWG

SEQ ID NO: 1390 - protein, 15 aa, Artificial Sequence
  epitope peptide
SLLCEVETPIRCEWG

SEQ ID NO: 1391 - protein, 15 aa, Artificial Sequence
  epitope peptide
SLLCEVETPICNEWG

SEQ ID NO: 1392 - protein, 15 aa, Artificial Sequence
  epitope peptide
SLLCEVETPCRNEWG

SEQ ID NO: 1393 - protein, 15 aa, Artificial Sequence
  epitope peptide
SLLCEVETCIRNEWG

SEQ ID NO: 1394 - protein, 15 aa, Artificial Sequence
  epitope peptide
SLLCEVECPIRNEWG

SEQ ID NO: 1395 - protein, 15 aa, Artificial Sequence
  epitope peptide
SLLCEVCTPIRNEWG

SEQ ID NO: 1396 - protein, 15 aa, Artificial Sequence
  epitope peptide
SLLCEVETPIRNEWG

SEQ ID NO: 1397 - protein, 15 aa, Artificial Sequence
  epitope peptide
CLLTEVCTPIRNEWG

SEQ ID NO: 1398 - protein, 15 aa, Artificial Sequence
  epitope peptide
SLLTEVETPIRNECC

SEQ ID NO: 1399 - protein, 15 aa, Artificial Sequence
  epitope peptide
SLLTEVETPIRNECG

SEQ ID NO: 1400 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): P is an attachment site for a CLIP
CLLTEVETPILLTEVETPICSLLTEVETP

SEQ ID NO: 1401 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): P is an attachment site for a CLIP
CLTEVETPIRLLTEVETPICSLLTEVETP

SEQ ID NO: 1402 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): P is an attachment site for a CLIP
CTEVETPIRNLLTEVETPICSLLTEVETP

SEQ ID NO: 1403 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): P is an attachment site for a CLIP
CEVETPIRNELLTEVETPICSLLTEVETP

SEQ ID NO: 1404 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): P is an attachment site for a CLIP
CETPIRNEWGLLTEVETPICSLLTEVETP

SEQ ID NO: 1405 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): E is an attachment site for a CLIP
  MISC_FEATURE (29)..(29): P is an attachment site for a CLIP
CTEVETPIRNETPIRNEWGCSLLTEVETP

SEQ ID NO: 1406 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): I is an attachment site for a CLIP
CLLTEVETPILLTEVETPICLLTEVETPI

SEQ ID NO: 1407 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): I is an attachment site for a CLIP
CLTEVETPIRLLTEVETPICLLTEVETPI

SEQ ID NO: 1408 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): I is an attachment site for a CLIP
CTEVETPIRNLLTEVETPICLLTEVETPI

SEQ ID NO: 1409 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): I is an attachment site for a CLIP
CEVETPIRNELLTEVETPICLLTEVETPI

SEQ ID NO: 1410 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): I is an attachment site for a CLIP
CVETPIRNEWLLTEVETPICLLTEVETPI

SEQ ID NO: 1411 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): I is an attachment site for a CLIP
CETPIRNEWGLLTEVETPICLLTEVETPI

SEQ ID NO: 1412 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): I is an attachment site for a CLIP
CLLTEVETPILTEVETPIRCLLTEVETPI

SEQ ID NO: 1413 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): I is an attachment site for a CLIP
CLTEVETPIRLTEVETPIRCLLTEVETPI

SEQ ID NO: 1414 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): I is an attachment site for a CLIP
CTEVETPIRNLTEVETPIRCLLTEVETPI

SEQ ID NO: 1415 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): I is an attachment site for a CLIP
CEVETPIRNELTEVETPIRCLLTEVETPI

SEQ ID NO: 1416 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): I is an attachment site for a CLIP
CVETPIRNEWLTEVETPIRCLLTEVETPI

SEQ ID NO: 1417 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): I is an attachment site for a CLIP
CETPIRNEWGLTEVETPIRCLLTEVETPI

SEQ ID NO: 1418 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): I is an attachment site for a CLIP
CLLTEVETPITEVETPIRNCLLTEVETPI

SEQ ID NO: 1419 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): T is an attachment site for a CLIP
  MISC_FEATURE (29)..(29): I is an attachment site for a CLIP
CLTEVETPIRTEVETPIRNCLLTEVETPI

SEQ ID NO: 1420 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): T is an attachment site for a CLIP
  MISC_FEATURE (29)..(29): I is an attachment site for a CLIP
CTEVETPIRNTEVETPIRNCLLTEVETPI

SEQ ID NO: 1421 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): T is an attachment site for a CLIP
  MISC_FEATURE (29)..(29): I is an attachment site for a CLIP
CEVETPIRNETEVETPIRNCLLTEVETPI

SEQ ID NO: 1422 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): T is an attachment site for a CLIP
  MISC_FEATURE (29)..(29): I is an attachment site for a CLIP
CVETPIRNEWTEVETPIRNCLLTEVETPI

SEQ ID NO: 1423 - protein, 29 aa, Artificial Sequence
  epitope peptide
CETPIRNEWGTEVETPIRNCLLTEVETPI

SEQ ID NO: 1424 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): I is an attachment site for a CLIP
CLLTEVETPIEVETPIRNECLLTEVETPI

SEQ ID NO: 1425 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): E is an attachment site for a CLIP
  MISC_FEATURE (29)..(29): I is an attachment site for a CLIP
CLTEVETPIREVETPIRNECLLTEVETPI

SEQ ID NO: 1426 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): E is an attachment site for a CLIP
  MISC_FEATURE (29)..(29): I is an attachment site for a CLIP
CTEVETPIRNEVETPIRNECLLTEVETPI

SEQ ID NO: 1427 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): I is an attachment site for a CLIP
CLLTEVETPIVETPIRNEWCLLTEVETPI

SEQ ID NO: 1428 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): V is an attachment site for a CLIP
  MISC_FEATURE (29)..(29): I is an attachment site for a CLIP
CLTEVETPIRVETPIRNEWCLLTEVETPI

SEQ ID NO: 1429 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): V is an attachment site for a CLIP
  MISC_FEATURE (29)..(29): I is an attachment site for a CLIP
CTEVETPIRNVETPIRNEWCLLTEVETPI

SEQ ID NO: 1430 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): V is an attachment site for a CLIP
  MISC_FEATURE (29)..(29): I is an attachment site for a CLIP
CEVETPIRNEVETPIRNEWCLLTEVETPI

SEQ ID NO: 1431 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): V is an attachment site for a CLIP
  MISC_FEATURE (29)..(29): I is an attachment site for a CLIP
CVETPIRNEWVETPIRNEWCLLTEVETPI

SEQ ID NO: 1432 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): V is an attachment site for a CLIP
  MISC_FEATURE (29)..(29): I is an attachment site for a CLIP
CETPIRNEWGVETPIRNEWCLLTEVETPI

SEQ ID NO: 1433 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): I is an attachment site for a CLIP
CLLTEVETPIETPIRNEWGCLLTEVETPI

SEQ ID NO: 1434 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): E is an attachment site for a CLIP
  MISC_FEATURE (29)..(29): I is an attachment site for a CLIP
CLTEVETPIRETPIRNEWGCLLTEVETPI

SEQ ID NO: 1435 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): E is an attachment site for a CLIP
  MISC_FEATURE (29)..(29): I is an attachment site for a CLIP
CTEVETPIRNETPIRNEWGCLLTEVETPI

SEQ ID NO: 1436 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): E is an attachment site for a CLIP
  MISC_FEATURE (29)..(29): I is an attachment site for a CLIP
CEVETPIRNEETPIRNEWGCLLTEVETPI

SEQ ID NO: 1437 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): E is an attachment site for a CLIP
  MISC_FEATURE (29)..(29): I is an attachment site for a CLIP
CVETPIRNEWETPIRNEWGCLLTEVETPI

SEQ ID NO: 1438 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): E is an attachment site for a CLIP
  MISC_FEATURE (29)..(29): I is an attachment site for a CLIP
CETPIRNEWGETPIRNEWGCLLTEVETPI

SEQ ID NO: 1439 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): S is an attachment site for a CLIP
  MISC_FEATURE (29)..(29): R is an attachment site for a CLIP
CSLLTEVETPSLLTEVETPCLTEVETPIR

SEQ ID NO: 1440 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): S is an attachment site for a CLIP
  MISC_FEATURE (29)..(29): R is an attachment site for a CLIP
CTEVETPIRNSLLTEVETPCLTEVETPIR

SEQ ID NO: 1441 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): R is an attachment site for a CLIP
CLLTEVETPILLTEVETPICLTEVETPIR

SEQ ID NO: 1442 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): R is an attachment site for a CLIP
CLTEVETPIRLLTEVETPICLTEVETPIR

SEQ ID NO: 1443 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): R is an attachment site for a CLIP
CTEVETPIRNLLTEVETPICLTEVETPIR

SEQ ID NO: 1444 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): R is an attachment site for a CLIP
CEVETPIRNELLTEVETPICLTEVETPIR

SEQ ID NO: 1445 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): R is an attachment site for a CLIP
CVETPIRNEWLLTEVETPICLTEVETPIR

SEQ ID NO: 1446 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): R is an attachment site for a CLIP
CETPIRNEWGLLTEVETPICLTEVETPIR

SEQ ID NO: 1447 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): R is an attachment site for a CLIP
CLLTEVETPILTEVETPIRCLTEVETPIR

SEQ ID NO: 1448 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): R is an attachment site for a CLIP
CLLTEVETPITEVETPIRNCLTEVETPIR

SEQ ID NO: 1449 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): R is an attachment site for a CLIP
CSLLTEVETPEVETPIRNECLTEVETPIR

SEQ ID NO: 1450 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): R is an attachment site for a CLIP
CLLTEVETPIEVETPIRNECLTEVETPIR

SEQ ID NO: 1451 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): R is an attachment site for a CLIP
CSLLTEVETPVETPIRNEWCLTEVETPIR

SEQ ID NO: 1452 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): R is an attachment site for a CLIP
CLLTEVETPIVETPIRNEWCLTEVETPIR

SEQ ID NO: 1453 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): R is an attachment site for a CLIP
CSLLTEVETPETPIRNEWGCLTEVETPIR

SEQ ID NO: 1454 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): R is an attachment site for a CLIP
CLLTEVETPIETPIRNEWGCLTEVETPIR

SEQ ID NO: 1455 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): N is an attachment site for a CLIP
CLLTEVETPISLLTEVETPCTEVETPIRN

SEQ ID NO: 1456 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): N is an attachment site for a CLIP
CSLLTEVETPLLTEVETPICTEVETPIRN

SEQ ID NO: 1457 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): N is an attachment site for a CLIP
CLLTEVETPILLTEVETPICTEVETPIRN

SEQ ID NO: 1458 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): N is an attachment site for a CLIP
CLTEVETPIRLLTEVETPICTEVETPIRN

SEQ ID NO: 1459 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): N is an attachment site for a CLIP
CTEVETPIRNLLTEVETPICTEVETPIRN

SEQ ID NO: 1460 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): N is an attachment site for a CLIP
CEVETPIRNELLTEVETPICTEVETPIRN

SEQ ID NO: 1461 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): N is an attachment site for a CLIP
CVETPIRNEWLLTEVETPICTEVETPIRN

SEQ ID NO: 1462 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): N is an attachment site for a CLIP
CETPIRNEWGLLTEVETPICTEVETPIRN

SEQ ID NO: 1463 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): N is an attachment site for a CLIP
CLLTEVETPILTEVETPIRCTEVETPIRN

SEQ ID NO: 1464 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): N is an attachment site for a CLIP
CSLLTEVETPTEVETPIRNCTEVETPIRN

SEQ ID NO: 1465 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): N is an attachment site for a CLIP
CLLTEVETPITEVETPIRNCTEVETPIRN

SEQ ID NO: 1466 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): N is an attachment site for a CLIP
CSLLTEVETPEVETPIRNECTEVETPIRN

SEQ ID NO: 1467 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): N is an attachment site for a CLIP
CLLTEVETPIEVETPIRNECTEVETPIRN

SEQ ID NO: 1468 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): N is an attachment site for a CLIP
CSLLTEVETPVETPIRNEWCTEVETPIRN

SEQ ID NO: 1469 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): N is an attachment site for a CLIP
CLLTEVETPIVETPIRNEWCTEVETPIRN

SEQ ID NO: 1470 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): N is an attachment site for a CLIP
CSLLTEVETPETPIRNEWGCTEVETPIRN

SEQ ID NO: 1471 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): N is an attachment site for a CLIP
CLLTEVETPIETPIRNEWGCTEVETPIRN

SEQ ID NO: 1472 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): E is an attachment site for a CLIP
CLLTEVETPISLLTEVETPCEVETPIRNE

SEQ ID NO: 1473 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): S is an attachment site for a CLIP
  MISC_FEATURE (29)..(29): E is an attachment site for a CLIP
CEVETPIRNESLLTEVETPCEVETPIRNE

SEQ ID NO: 1474 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): S is an attachment site for a CLIP
  MISC_FEATURE (29)..(29): E is an attachment site for a CLIP
CVETPIRNEWSLLTEVETPCEVETPIRNE

SEQ ID NO: 1475 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): S is an attachment site for a CLIP
  MISC_FEATURE (29)..(29): E is an attachment site for a CLIP
CETPIRNEWGSLLTEVETPCEVETPIRNE

SEQ ID NO: 1476 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): E is an attachment site for a CLIP
CSLLTEVETPLLTEVETPICEVETPIRNE

SEQ ID NO: 1477 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): E is an attachment site for a CLIP
CLLTEVETPILLTEVETPICEVETPIRNE

SEQ ID NO: 1478 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): E is an attachment site for a CLIP
CLTEVETPIRLLTEVETPICEVETPIRNE

SEQ ID NO: 1479 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): E is an attachment site for a CLIP
CTEVETPIRNLLTEVETPICEVETPIRNE

SEQ ID NO: 1480 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): E is an attachment site for a CLIP
CEVETPIRNELLTEVETPICEVETPIRNE

SEQ ID NO: 1481 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): E is an attachment site for a CLIP
CVETPIRNEWLLTEVETPICEVETPIRNE

SEQ ID NO: 1482 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): E is an attachment site for a CLIP
CETPIRNEWGLLTEVETPICEVETPIRNE

SEQ ID NO: 1483 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): E is an attachment site for a CLIP
CSLLTEVETPLTEVETPIRCEVETPIRNE

SEQ ID NO: 1484 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): E is an attachment site for a CLIP
CLLTEVETPILTEVETPIRCEVETPIRNE

SEQ ID NO: 1485 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): E is an attachment site for a CLIP
CSLLTEVETPTEVETPIRNCEVETPIRNE

SEQ ID NO: 1486 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): E is an attachment site for a CLIP
CLLTEVETPITEVETPIRNCEVETPIRNE

SEQ ID NO: 1487 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): E is an attachment site for a CLIP
CSLLTEVETPEVETPIRNECEVETPIRNE

SEQ ID NO: 1488 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): E is an attachment site for a CLIP
CLLTEVETPIEVETPIRNECEVETPIRNE

SEQ ID NO: 1489 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): E is an attachment site for a CLIP
CSLLTEVETPVETPIRNEWCEVETPIRNE

SEQ ID NO: 1490 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): E is an attachment site for a CLIP
CLLTEVETPIVETPIRNEWCEVETPIRNE

SEQ ID NO: 1491 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): E is an attachment site for a CLIP
CSLLTEVETPETPIRNEWGCEVETPIRNE

SEQ ID NO: 1492 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): E is an attachment site for a CLIP
CLLTEVETPIETPIRNEWGCEVETPIRNE

SEQ ID NO: 1493 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): W is an attachment site for a CLIP
CLLTEVETPILLTEVETPICVETPIRNEW

SEQ ID NO: 1494 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): W is an attachment site for a CLIP
CLTEVETPIRLLTEVETPICVETPIRNEW

SEQ ID NO: 1495 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): W is an attachment site for a CLIP
CTEVETPIRNLLTEVETPICVETPIRNEW

SEQ ID NO: 1496 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): W is an attachment site for a CLIP
CEVETPIRNELLTEVETPICVETPIRNEW

SEQ ID NO: 1497 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): W is an attachment site for a CLIP
CVETPIRNEWLLTEVETPICVETPIRNEW

SEQ ID NO: 1498 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): W is an attachment site for a CLIP
CETPIRNEWGLLTEVETPICVETPIRNEW

SEQ ID NO: 1499 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): L is an attachment site for a CLIP
  MISC_FEATURE (29)..(29): W is an attachment site for a CLIP
CSLLTEVETPLTEVETPIRCVETPIRNEW

SEQ ID NO: 1500 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): W is an attachment site for a CLIP
CLLTEVETPILTEVETPIRCVETPIRNEW

SEQ ID NO: 1501 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): W is an attachment site for a CLIP
CSLLTEVETPTEVETPIRNCVETPIRNEW

SEQ ID NO: 1502 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): W is an attachment site for a CLIP
CLLTEVETPITEVETPIRNCVETPIRNEW

SEQ ID NO: 1503 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): W is an attachment site for a CLIP
CSLLTEVETPEVETPIRNECVETPIRNEW

SEQ ID NO: 1504 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): W is an attachment site for a CLIP
CLLTEVETPIEVETPIRNECVETPIRNEW

SEQ ID NO: 1505 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): W is an attachment site for a CLIP
CSLLTEVETPVETPIRNEWCVETPIRNEW

SEQ ID NO: 1506 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): W is an attachment site for a CLIP
CLLTEVETPIVETPIRNEWCVETPIRNEW

SEQ ID NO: 1507 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): W is an attachment site for a CLIP
CSLLTEVETPETPIRNEWGCVETPIRNEW

SEQ ID NO: 1508 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): W is an attachment site for a CLIP
CLLTEVETPIETPIRNEWGCVETPIRNEW

SEQ ID NO: 1509 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): S is an attachment site for a CLIP
  MISC_FEATURE (29)..(29): G is an attachment site for a CLIP
CLLTEVETPISLLTEVETPCETPIRNEWG

SEQ ID NO: 1510 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): G is an attachment site for a CLIP
CLLTEVETPILLTEVETPICETPIRNEWG

SEQ ID NO: 1511 - protein, 29 aa, Artificial Sequence
  epitope peptide
  MISC_FEATURE (1)..(1): C is an attachment site for a CLIP
  MISC_FEATURE (10)..(10): R is an attachment site for a CLIP
  MISC_FEATURE (11)..(11): L is an attachment site for a CLIP
  MISC_FEATURE (29)..(29): G is an attachment site for a CLIP
CLTEVETPIRLLTEVETPICETPIRNEWG

SEQ ID NO: 1512 - protein, 29 aa, Artificial Sequence
  epitope peptide
  MISC_FEATURE (1)..(1): C is an attachment site for a CLIP
  MISC_FEATURE (10)..(10): N is an attachment site for a CLIP
  MISC_FEATURE (11)..(11): L is an attachment site for a CLIP
  MISC_FEATURE (29)..(29): G is an attachment site for a CLIP
CTEVETPIRNLLTEVETPICETPIRNEWG

SEQ ID NO: 1513 - protein, 29 aa, Artificial Sequence
  epitope peptide
  MISC_FEATURE (1)..(1): C is an attachment site for a CLIP
  MISC_FEATURE (10)..(10): E is an attachment site for a CLIP
  MISC_FEATURE (11)..(11): L is an attachment site for a CLIP
  MISC_FEATURE (29)..(29): G is an attachment site for a CLIP
CEVETPIRNELLTEVETPICETPIRNEWG

SEQ ID NO: 1514 - protein, 29 aa, Artificial Sequence
  epitope peptide
  MISC_FEATURE (1)..(1): C is an attachment site for a CLIP
  MISC_FEATURE (10)..(10): W is an attachment site for a CLIP
  MISC_FEATURE (11)..(11): L is an attachment site for a CLIP
  MISC_FEATURE (29)..(29): G is an attachment site for a CLIP
CVETPIRNEWLLTEVETPICETPIRNEWG

SEQ ID NO: 1515 - protein, 29 aa, Artificial Sequence
  epitope peptide
  MISC_FEATURE (1)..(1): C is an attachment site for a CLIP
  MISC_FEATURE (10)..(10): G is an attachment site for a CLIP
  MISC_FEATURE (11)..(11): L is an attachment site for a CLIP
  MISC_FEATURE (29)..(29): G is an attachment site for a CLIP
CETPIRNEWGLLTEVETPICETPIRNEWG

SEQ ID NO: 1516 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): L is an attachment site for a CLIP
  MISC_FEATURE (29)..(29): G is an attachment site for a CLIP
CLLTEVETPILTEVETPIRCETPIRNEWG

SEQ ID NO: 1517 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): T is an attachment site for a CLIP
  MISC_FEATURE (29)..(29): G is an attachment site for a CLIP
CSLLTEVETPTEVETPIRNCETPIRNEWG

SEQ ID NO: 1518 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): T is an attachment site for a CLIP
  MISC_FEATURE (29)..(29): G is an attachment site for a CLIP
CLLTEVETPITEVETPIRNCETPIRNEWG

SEQ ID NO: 1519 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): G is an attachment site for a CLIP
CSLLTEVETPEVETPIRNECETPIRNEWG

SEQ ID NO: 1520 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): G is an attachment site for a CLIP
CLLTEVETPIEVETPIRNECETPIRNEWG

SEQ ID NO: 1521 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): V is an attachment site for a CLIP
  MISC_FEATURE (29)..(29): G is an attachment site for a CLIP
CSLLTEVETPVETPIRNEWCETPIRNEWG

SEQ ID NO: 1522 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): V is an attachment site for a CLIP
  MISC_FEATURE (29)..(29): G is an attachment site for a CLIP
CLLTEVETPIVETPIRNEWCETPIRNEWG

SEQ ID NO: 1523 - protein, 29 aa, Artificial Sequence
  epitope peptide
  MISC_FEATURE (1)..(1): C is an attachment site for a CLIP
  MISC_FEATURE (10)..(10): P is an attachment site for a CLIP
  MISC_FEATURE (11)..(11): E is an attachment site for a CLIP
  MISC_FEATURE (29)..(29): G is an attachment site for a CLIP
CSLLTEVETPETPIRNEWGCETPIRNEWG

SEQ ID NO: 1524 - protein, 29 aa, Artificial Sequence
  epitope peptide
  MISC_FEATURE (1)..(1): C is an attachment site for a CLIP
  MISC_FEATURE (10)..(10): I is an attachment site for a CLIP
  MISC_FEATURE (11)..(11): E is an attachment site for a CLIP
  MISC_FEATURE (29)..(29): G is an attachment site for a CLIP
CLLTEVETPIETPIRNEWGCETPIRNEWG

SEQ ID NO: 1525 - protein, 33 aa, Artificial Sequence
  epitope peptide
CLLTEVETPIRNEWGSCVETPIRNEWGSRSNDC

SEQ ID NO: 1526 - protein, 32 aa, Artificial Sequence
  epitope peptide
CSLLTEVETPIRNEWCETPIRNEWGSRSNDSC

SEQ ID NO: 1527 - protein, 33 aa, Artificial Sequence
  epitope peptide
CLLTEVETPIRNEWGSCETPIRNEWGSRSNDSC

SEQ ID NO: 1528 - protein, 32 aa, Artificial Sequence
  epitope peptide
CSLLTEVETPIRNEWCTPIRNEWGSRSNDSSC

SEQ ID NO: 1529 - protein, 33 aa, Artificial Sequence
  epitope peptide
CLLTEVETPIRNEWGSCTPIRNEWGSRSNDSSC

SEQ ID NO: 1530 - protein, 32 aa, Artificial Sequence
  epitope peptide
CSLLTEVETPIRNEWCPIRNEWGSRSNDSSDC

SEQ ID NO: 1531 - protein, 33 aa, Artificial Sequence
  epitope peptide
CLLTEVETPIRNEWGSCPIRNEWGSRSNDSSDC

SEQ ID NO: 1532 - protein, 24 aa, Artificial Sequence
  epitope peptide
CSLLTEVETPIRNEWGCRCNDSSD

SEQ ID NO: 1533 - protein, 23 aa, Artificial Sequence
  epitope peptide
CLLTEVETPIRNEWGCRCNDSSD

SEQ ID NO: 1534 - protein, 23 aa, Artificial Sequence
  epitope peptide
SLLCEVETPIRNEWGCRCNDSSD

SEQ ID NO: 1535 - protein, 26 aa, Artificial Sequence
  epitope peptide
CSLLTEVETPICSLLTEVETPIRNEC

SEQ ID NO: 1536 - protein, 33 aa, Artificial Sequence
  epitope peptide
CLLTEVETPIRNEWGSCLLTEVETPIRNEWGSC

SEQ ID NO: 1537 - protein, 33 aa, Artificial Sequence
  epitope peptide
CLTEVETPIRNEWGSRCLLTEVETPIRNEWGSC

SEQ ID NO: 1538 - protein, 33 aa, Artificial Sequence
  epitope peptide
CTEVETPIRNEWGSRSCLLTEVETPIRNEWGSC

SEQ ID NO: 1539 - protein, 33 aa, Artificial Sequence
  epitope peptide
CEVETPIRNEWGSRSNCLLTEVETPIRNEWGSC

SEQ ID NO: 1540 - protein, 33 aa, Artificial Sequence
  epitope peptide
CVETPIRNEWGSRSNDCLLTEVETPIRNEWGSC

SEQ ID NO: 1541 - protein, 33 aa, Artificial Sequence
  epitope peptide
CETPIRNEWGSRSNDSCLLTEVETPIRNEWGSC

SEQ ID NO: 1542 - protein, 33 aa, Artificial Sequence
  epitope peptide
CTPIRNEWGSRSNDSSCLLTEVETPIRNEWGSC

SEQ ID NO: 1543 - protein, 33 aa, Artificial Sequence
  epitope peptide
CPIRNEWGSRSNDSSDCLLTEVETPIRNEWGSC

SEQ ID NO: 1544 - protein, 33 aa, Artificial Sequence
  epitope peptide
CLLTEVETPIRNEWGSCLTEVETPIRNEWGSRC

SEQ ID NO: 1545 - protein, 33 aa, Artificial Sequence
  epitope peptide
CLLTEVETPIRNEWGSCTEVETPIRNEWGSRSC

SEQ ID NO: 1546 - protein, 32 aa, Artificial Sequence
  epitope peptide
CSLLTEVETPIRNEWCEVETPIRNEWGSRSNC

SEQ ID NO: 1547 - protein, 33 aa, Artificial Sequence
  epitope peptide
CLLTEVETPIRNEWGSCEVETPIRNEWGSRSNC

SEQ ID NO: 1548 - protein, 28 aa, Artificial Sequence
  epitope peptide
CSLLTEVETPICVETPIRNEWGSRSNDC

SEQ ID NO: 1549 - protein, 32 aa, Artificial Sequence
  epitope peptide
CSLLTEVETPIRNEWCVETPIRNEWGSRSNDC

SEQ ID NO: 1550 - protein, 13 aa, Artificial Sequence
  epitope peptide
SLLCEVGCLLTEV

SEQ ID NO: 1551 - protein, 13 aa, Artificial Sequence
  epitope peptide
SLLCEVGSCLTEV

SEQ ID NO: 1552 - protein, 13 aa, Artificial Sequence
  epitope peptide
SLLCEVGSLCTEV

SEQ ID NO: 1553 - protein, 13 aa, Artificial Sequence
  epitope peptide
CLLTEVGSLLCEV

SEQ ID NO: 1554 - protein, 13 aa, Artificial Sequence
  epitope peptide
SLLCEVGSLLCEV

SEQ ID NO: 1555 - protein, 13 aa, Artificial Sequence
  epitope peptide
SLLTCVGSLLCEV

SEQ ID NO: 1556 - protein, 14 aa, Artificial Sequence
  epitope peptide
CSCLCEVGSLLCEV

SEQ ID NO: 1557 - protein, 13 aa, Artificial Sequence
  epitope peptide
CLCTCVGSLLCEV

SEQ ID NO: 1558 - protein, 13 aa, Artificial Sequence
  epitope peptide
SCLCECGSLLCEV

SEQ ID NO: 1559 - protein, 13 aa, Artificial Sequence
  epitope peptide
SLLCEVGSLLTCV

SEQ ID NO: 1560 - protein, 14 aa, Artificial Sequence
  epitope peptide
SLLCEVGCSCLCEV

SEQ ID NO: 1561 - protein, 13 aa, Artificial Sequence
  epitope peptide
SLLCEVGCLCTCV

SEQ ID NO: 1562 - protein, 13 aa, Artificial Sequence
  epitope peptide
SLLCEVGSCLCEC

SEQ ID NO: 1563 - protein, 23 aa, Artificial Sequence
  epitope peptide
DLLTEVETPIRNEWGCRCNDSSD

SEQ ID NO: 1564 - protein, 23 aa, Artificial Sequence
  epitope peptide
ELLTEVETPIRNEWGCRCNDSSD

SEQ ID NO: 1565 - protein, 23 aa, Artificial Sequence
  epitope peptide
FLLTEVETPIRNEWGCRCNDSSD

SEQ ID NO: 1566 - protein, 23 aa, Artificial Sequence
  epitope peptide
GLLTEVETPIRNEWGCRCNDSSD

SEQ ID NO: 1567 - protein, 23 aa, Artificial Sequence
  epitope peptide
HLLTEVETPIRNEWGCRCNDSSD

SEQ ID NO: 1568 - protein, 23 aa, Artificial Sequence
  epitope peptide
ILLTEVETPIRNEWGCRCNDSSD

SEQ ID NO: 1569 - protein, 23 aa, Artificial Sequence
  epitope peptide
KLLTEVETPIRNEWGCRCNDSSD

SEQ ID NO: 1570 - protein, 23 aa, Artificial Sequence
  epitope peptide
MLLTEVETPIRNEWGCRCNDSSD

SEQ ID NO: 1571 - protein, 23 aa, Artificial Sequence
  epitope peptide
NLLTEVETPIRNEWGCRCNDSSD

SEQ ID NO: 1572 - protein, 23 aa, Artificial Sequence
  epitope peptide
PLLTEVETPIRNEWGCRCNDSSD

SEQ ID NO: 1573 - protein, 23 aa, Artificial Sequence
  epitope peptide
QLLTEVETPIRNEWGCRCNDSSD

SEQ ID NO: 1574 - protein, 23 aa, Artificial Sequence
  epitope peptide
RLLTEVETPIRNEWGCRCNDSSD

SEQ ID NO: 1575 - protein, 23 aa, Artificial Sequence
  epitope peptide
WLLTEVETPIRNEWGCRCNDSSD

SEQ ID NO: 1576 - protein, 23 aa, Artificial Sequence
  epitope peptide
YLLTEVETPIRNEWGCRCNDSSD

SEQ ID NO: 1577 - protein, 23 aa, Artificial Sequence
  epitope peptide
SLDTEVETPIRNEWGCRCNDSSD

SEQ ID NO: 1578 - protein, 23 aa, Artificial Sequence
  epitope peptide
SLLAEVETPIRNEWGCRCNDSSD

SEQ ID NO: 1579 - protein, 23 aa, Artificial Sequence
  epitope peptide
SLLDEVETPIRNEWGCRCNDSSD

SEQ ID NO: 1580 - protein, 23 aa, Artificial Sequence
  epitope peptide
SLLEEVETPIRNEWGCRCNDSSD

SEQ ID NO: 1581 - protein, 23 aa, Artificial Sequence
  epitope peptide
SLLFEVETPIRNEWGCRCNDSSD

SEQ ID NO: 1582 - protein, 23 aa, Artificial Sequence
  epitope peptide
SLLGEVETPIRNEWGCRCNDSSD

SEQ ID NO: 1583 - protein, 23 aa, Artificial Sequence
  epitope peptide
SLLHEVETPIRNEWGCRCNDSSD

SEQ ID NO: 1584 - protein, 23 aa, Artificial Sequence
  epitope peptide
SLLIEVETPIRNEWGCRCNDSSD

SEQ ID NO: 1585 - protein, 23 aa, Artificial Sequence
  epitope peptide
SLLKEVETPIRNEWGCRCNDSSD

SEQ ID NO: 1586 - protein, 23 aa, Artificial Sequence
  epitope peptide
SLLLEVETPIRNEWGCRCNDSSD

SEQ ID NO: 1587 - protein, 23 aa, Artificial Sequence
  epitope peptide
SLLNEVETPIRNEWGCRCNDSSD

SEQ ID NO: 1588 - protein, 23 aa, Artificial Sequence
  epitope peptide
SLLREVETPIRNEWGCRCNDSSD

SEQ ID NO: 1589 - protein, 23 aa, Artificial Sequence
  epitope peptide
SLLVEVETPIRNEWGCRCNDSSD

SEQ ID NO: 1590 - protein, 23 aa, Artificial Sequence
  epitope peptide
SLLWEVETPIRNEWGCRCNDSSD

SEQ ID NO: 1591 - protein, 23 aa, Artificial Sequence
  epitope peptide
SLLYEVETPIRNEWGCRCNDSSD

SEQ ID NO: 1592 - protein, 14 aa, Artificial Sequence
  epitope peptide
CSLLTECGSLLTCV

SEQ ID NO: 1593 - protein, 14 aa, Artificial Sequence
  epitope peptide
SLLTECGSLLTECV

SEQ ID NO: 1594 - protein, 11 aa, Artificial Sequence
  epitope peptide
  misc_feature (3)..(3): Xaa can be any naturally occurring amino acid
  misc_feature (7)..(7): Xaa can be any naturally occurring amino acid
LLXEVEXPIRN

SEQ ID NO: 1595 - protein, 14 aa, Artificial Sequence
  epitope peptide
CSLLTECGSLLTCV

SEQ ID NO: 1596 - protein, 13 aa, Artificial Sequence
  epitope peptide
SLLTECGSLLTCV

SEQ ID NO: 1597 - protein, 6 aa, Artificial Sequence
  epitope core variant
  misc_feature (6)..(6): Xaa can be any naturally occurring amino acid
SLLTEX

SEQ ID NO: 1598 - protein, 7 aa, Artificial Sequence
  epitope core variant
  misc_feature (6)..(6): Xaa can be any naturally occurring amino acid
SLLTEXZ

What is claimed:

1. A peptide immunogen consisting of the sequence of:

$[Xaa_0]_m\text{-}Xaa_1\text{-}Xaa_2\text{-}Xaa_3\text{-}Xaa_4\text{-}Xaa_5\text{-}[Xaa_6]_p\text{-}$
$[Xaa_7]_q\text{-}[Xaa_8\text{-}[Xaa_0]_m\text{-}Xaa_1\text{-}Xaa_2\text{-}Xaa_3\text{-}Xaa_4\text{-}Xaa_5\text{-}$
$[Xaa_6]_p\text{-}[Xaa_7]_q]_n$ wherein, m, p and q are independently 0 or 1,
n is any number between 1 and 4,
$Xaa_0$, $Xaa_6$, $Xaa_7$ and $Xaa_8$ is independently any amino acid,
$Xaa_1\text{-}Xaa_2\text{-}Xaa_3\text{-}Xaa_4\text{-}Xaa_5$ is S-L-L-T-E.

2. The peptide immunogen of claim 1, wherein $Xaa_0$ is C.

3. The peptide immunogen of claim 1, wherein $Xaa_6$ is V or C.

4. The peptide immunogen of claim 1, wherein $Xaa_7$ is E.

5. The peptide immunogen of claim 1, wherein $Xaa_8$ is G or A.

6. The peptide immunogen of claim 1, wherein said peptide is non-linear, and wherein said peptide is cyclic, and n is any number between 1 and 4.

7. The peptide immunogen of claim 1, wherein said peptide is a Linear or cyclized peptide having the sequence SLLTEVGSLLTEV (SEQ ID NO: 320).

* * * * *